US011242568B2

(12) United States Patent
Hahn et al.

(10) Patent No.: US 11,242,568 B2
(45) Date of Patent: Feb. 8, 2022

(54) DNA METHYLATION DIAGNOSTIC TEST FOR BREAST CANCER

(71) Applicant: City of Hope, Duarte, CA (US)

(72) Inventors: Maria A. Hahn, Duarte, CA (US); John H. Yim, San Marino, CA (US); Yuman Fong, La Canada Flintridge, CA (US); Arthur X. Li, Covina, CA (US); Xiwei Wu, Diamond Bar, CA (US); Sun-Wing T. R. Tong, Duarte, CA (US)

(73) Assignee: City of Hope, Duarte, CA (US)

( * ) Notice: Subject to any disclaimer, the term of this patent is extended or adjusted under 35 U.S.C. 154(b) by 102 days.

(21) Appl. No.: 16/235,968

(22) Filed: Dec. 28, 2018

(65) Prior Publication Data

US 2019/0284633 A1    Sep. 19, 2019

Related U.S. Application Data

(60) Provisional application No. 62/611,910, filed on Dec. 29, 2017.

(51) Int. Cl.
*C12Q 1/6886*     (2018.01)

(52) U.S. Cl.
CPC ...... *C12Q 1/6886* (2013.01); *C12Q 2600/118* (2013.01); *C12Q 2600/154* (2013.01)

(58) Field of Classification Search
None
See application file for complete search history.

(56) References Cited

U.S. PATENT DOCUMENTS

| | | | |
|---|---|---|---|
| 5,034,506 | A | 7/1991 | Summerton et al. |
| 5,235,033 | A | 8/1993 | Summerton et al. |
| 5,925,517 | A | 7/1999 | Tyagi et al. |
| 6,037,130 | A | 3/2000 | Tyagi et al. |
| 6,150,097 | A | 11/2000 | Tyagi et al. |
| 2009/0215709 | A1* | 8/2009 | Van Criekinge ........ A61P 35/04 514/34 |

FOREIGN PATENT DOCUMENTS

WO    WO-92/02638 A1    2/1992

OTHER PUBLICATIONS

Ushijima et al. Nature Reviews. 2005. 5: 223-231 (Year: 2005).*
Ehrlich et al. Oncogene 2002. 21: 5400-5413 (Year: 2002).*
Pang et al Breast Cancer Research. 2013. 15(3): 206, pp. 1-11 (Year: 2013).*
Abba et al Cancer Research. Sep. 15, 2015, online Aug. 6, 2015. 75(18): 3980-3990 (Year: 2015).*
Adalsteinsson et al PLoS One. Oct. 2012. 7(10): e0046705 (Year: 2012).*
Abba et al. Supplementary Table S5, pp. 1-175, available via URL: <https://www.ncbi.nlm.nih.gov/pmc/articles/PMC4768486/>, from Abba et al. Cancer Research. 2015. 75(18): 3980-3990. (Year: 2015).*
Illumina. Infinium® HumanMethylation450 BeadChip. 2012, Illumina, Inc., available via URL: < illumina.com/content/dam/illumina-marketing/documents/products/datasheets/datasheet_humanmethylation450.pdf> (Year: 2012).*
Johnson et al Clinical Epigenetics. 2015. 7:75, 12 pages (Year: 2015).*
Altschul, S.F. et al. (Oct. 5, 1990). "Basic local alignment search tool," *J. Mol. Biol.* 215(3):403-410.
Altschul, S.F. et al. (Sep. 1997). "Gapped BLAST and PSI-BLAST: a new generation of protein database search programs," *Nuc. Acids Res.* 25(17):3389-3402.
Blok, H.J. et al. (Jun. 1997). "Amplifiable hybridization probes containing a molecular switch," *Mol Cell Probes* 11 (3):187-194.
Bonnet, G. et al. (May 25, 1999). "Thermodynamic basis of the enhanced specificity of structured DNA probes," *PNAS USA* 96(11):6171-6176.
Chee, M. et al. (Oct. 25, 1996). "Accessing genetic information with high-density DNA arrays," *Science* 274(5287):610-614.
Fang, X.et al. (1999). "Designing a Novel Molecular Beacon for Surface-Immobilized DNA Hybridization Studies," *J Am Chem Soc* 121:2921-2922.
Fodor (Jul. 31, 1997) "Genes, Chips and the Human Genome." *The FASEB Journal*, Abstracts, 11(9):A879.
Fodor (Jul. 18, 1997). "DNA Sequencing: Massively Parallel Genomics." *Science* 277(5324): 393-395.
Hsuih, T.C. et al. (Mar. 1996). "Novel, ligation-dependent PCR assay for detection of hepatitis C in serum," *J Clin Microbiol* 34(3):501-507.
Kent, W.J. et al. (Jun. 2002). "The human genome browser at UCSC," *Genome Res* 12(6):996-1006.
Kostrikis, L.G. et al. (Feb. 20, 1998). "Spectral genotyping of human alleles," *Science* 279(5354):1228-1229.
Leone, G. et al. (May 1, 1998). "Molecular beacon probes combined with amplification by NASBA enable homogeneous, real-time detection of RNA," *Nucleic Acids Research* 26(9):2150-2155.
Lockhart, D.J. (Nov. 1998). "Mutant yeast on drugs," *Nat Med* 4(11):1235-1236.
Marras, S.A. et al. (Feb. 1999). "Multiplex detection of single-nucleotide variations using molecular beacons," *Genet Anal* 14(5-6):151-156.
Sanger, F. et al. (May 25, 1975). "A rapid method for determining sequences in DNA by primed synthesis with DNA polymerase," *J Mol Biol* 94(3):441-448.

(Continued)

*Primary Examiner* — Carla J Myers

(74) *Attorney, Agent, or Firm* — Mintz, Levin, Cohn, Ferris, Glovsky and Popeo, P.C.

(57) ABSTRACT

The present subject matter provides, inter alia, a method of diagnosing invasive ductal cancer or detecting invasive ductal cancer risk in a subject who has ductal carcinoma in situ, a method of treating breast cancer in a subject detected to have invasive ductal cancer or determined to be at risk of invasive ductal cancer, compositions for detecting invasive presence or potential in ductal carcinoma in situ in a subject, and kits including reagents and composition for detecting invasive presence or potential in ductal carcinoma in situ in a subject.

12 Claims, 7 Drawing Sheets

Specification includes a Sequence Listing.

(56) References Cited

OTHER PUBLICATIONS

Sanger F. et al. (1997). "DNA sequencing with chain-terminating inhibitors" *PNAS*, 74(12):5463-5467.
Sapolsky, R.J. et al. (Feb. 1999). "High-throughput polymorphism screening and genotyping with high-density oligonucleotide arrays," *Genet Anal* 14(5-6):187-192.
Sokol, D.L. et al. (Sep. 29, 1998). "Real time detection of DNA. RNA hybridization in living cells," *PNAS USA* 95(20):11538-11543.
Tyagi, S. et al. (Mar. 1996). "Molecular beacons: probes that fluoresce upon hybridization," *Nat Biotechnol* 14(3):303-308.
Tyagi, S. et al. (Jan. 1998). "Multicolor molecular beacons for allele discrimination," *Nat Biotechnol* 16(1):49-53.
Vet, J.A. et al. (May 25, 1999). "Multiplex detection of four pathogenic retroviruses using molecular beacons," *PNAS USA* 96(11):6394-6399.

\* cited by examiner

| Epigenetic group | ID | ER/PR | DCIS, grade | Invasiveness/ Independent evaluation |
|---|---|---|---|---|
| Non-invasive | 4 | ER-positive, PR - N/A | high | No |
| | 5 | POSITIVE | low | No |
| | 7 | POSITIVE | intermediate | No |
| | 8 | POSITIVE | intermediate | No |
| Invasive | 1 | POSITIVE | high | No |
| | 3 | NEGATIVE | high | No |
| | 6 | NEGATIVE | high | Invasive |
| | 11 | N/A | intermediate | IDC |
| | 13 | POSITIVE | intermediate | IDC |
| | 14 | POSITIVE | high | IDC |

FIG. 1C

DNA METHYLATION DIAGNOSTIC TEST FOR BREAST CANCER

CROSS-REFERENCE TO RELATED APPLICATIONS

This application claims the benefit of priority to U.S. Provisional Application No. 62/611,910, filed Dec. 29, 2017, which is hereby incorporated by reference in its entirety for all purposes.

SEQUENCE LISTING

The instant application contains a Sequence Listing which has been filed electronically in ASCII format and is hereby incorporated by reference in its entirety. Said ASCII copy, created on Mar. 25, 2019, is named 048440-619001US_SL.txt and is 648,006 bytes in size.

BACKGROUND OF THE INVENTION

Invasive breast cancer represents a quarter of all cancers diagnosed worldwide and its rate increases by 0.3% every year. Ductal carcinoma in situ (DCIS) is considered to be a pre-invasive form of breast cancer. Almost a quarter of all new breast cancers diagnosed in the United States are DCIS. However, patients with DCIS are treated with surgery and radiation, identically to patients presenting with invasive disease. Not all women with untreated DCIS will develop invasive ductal cancer (IDC). At present, there is no tool to predict concurrent or subsequent invasion in DCIS. This results in overtreatment of a significant number of patients who carry the stigma of cancer.

BRIEF SUMMARY OF THE INVENTION

The present subject matter provides, inter alia, methods, compounds, compositions, kits, and systems for diagnosing IDC or detecting IDC risk in a subject who has DCIS, treating breast cancer in a subject detected to have IDS or determined to be at risk of IDC, and detecting invasive competent DCIS and invasive incompetent DCIS in a subject.

In an aspect, provided herein is a method for detecting the presence, absence, and/or level of methylation at one or more sites set forth in Table 1. In embodiments, the level of methylation at a site set forth in Table 1 is detected.

In an aspect, included herein is method of detecting methylation or unmethylation of a DCIS cell DNA molecule of a subject. In embodiments, the method comprises (i) contacting an isolated DCIS cancer cell proliferation DNA molecule from the subject with a bisulfite salt thereby forming a reacted DCIS cancer cell proliferation DNA molecule; and (ii) detecting the presence or absence of uracil in the reacted DCIS cancer cell proliferation DNA molecule at a methylation site set forth in Table 1, thereby detecting methylation or unmethylation of the DCIS cancer cell proliferation DNA molecule of the subject.

In embodiments, provided herein is a method of detecting methylation or unmethylation of a DCIS cancer cell proliferation DNA molecule of a subject. In embodiments, the method comprises (i) isolating a DCIS cancer cell proliferation DNA molecule from a DCIS cancer cell proliferation of the subject thereby forming an isolated DCIS cancer cell proliferation DNA molecule; (ii) contacting the isolated DCIS cancer cell proliferation DNA molecule with a bisulfite salt thereby forming a reacted DCIS cancer cell proliferation DNA molecule; and (iii) detecting the presence or absence of uracil in the reacted DCIS cancer cell proliferation DNA molecule at a methylation site set forth in Table 1, thereby detecting methylation or unmethylation of the DCIS cancer cell proliferation DNA molecule of the subject.

Also provided herein is a method of detecting methylation or unmethylation of a plurality of DCIS cancer cell proliferation DNA molecules of a subject. In embodiments, the method comprises (i) contacting a plurality of isolated DCIS cancer cell proliferation DNA molecules from the subject with a bisulfite salt thereby forming a plurality of reacted DCIS cancer cell proliferation DNA molecules; and (ii) detecting the level of uracil in the plurality of reacted DCIS cancer cell proliferation DNA molecules at a plurality of methylation sites set forth in Table 1, thereby detecting the level of methylation or unmethylation in the plurality of DCIS cancer cell proliferation DNA molecules of the subject.

Embodiments also provide a method of detecting methylation or unmethylation of a plurality of DCIS cancer cell proliferation DNA molecules of a subject. In embodiments, the method comprises (i) isolating a plurality of DCIS cancer cell proliferation DNA molecules from the DCIS cancer cell proliferation of the subject thereby forming a plurality of isolated DCIS cancer cell proliferation DNA molecules; (ii) contacting the plurality of isolated DCIS cancer cell proliferation DNA molecules with a bisulfite salt thereby forming a plurality of reacted DCIS cancer cell proliferation DNA molecules; and detecting the level of uracil in the plurality of reacted DCIS cancer cell proliferation DNA molecules at a plurality of methylation sites set forth in Table 1, thereby detecting the level of methylation or unmethylation in the plurality of DCIS cancer cell proliferation DNA molecules of the subject.

In an aspect, further provided is a method of detecting a risk of developing IDC in a subject who has DCIS. In embodiments, the method comprises (i) contacting an isolated DCIS cancer cell proliferation DNA molecule from the subject with a bisulfite salt thereby forming a reacted DCIS cancer cell proliferation DNA molecule; and (ii) detecting the presence or absence of uracil in the reacted DCIS cancer cell proliferation DNA molecule at a methylation site set forth in Table 1, thereby detecting the risk for developing IDC in the subject. In embodiments, the method comprises (i) contacting a plurality of isolated DCIS cancer cell proliferation DNA molecules from the subject with a bisulfite salt thereby forming a plurality of reacted DCIS cancer cell proliferation DNA molecules; and (ii) detecting the level of reacted DCIS cancer cell proliferation DNA molecules in the plurality of reacted DCIS cancer cell proliferation DNA molecules having a uracil at a plurality of methylation sites set forth in Table 1, thereby detecting the risk for IDC in the subject.

Also provided is a method of detecting IDC or a risk of developing IDC in a subject. In embodiments, the method includes (i) isolating a DCIS cancer cell proliferation DNA molecule from DCIS tissue of the subject thereby forming an isolated DCIS cancer cell proliferation DNA molecule; (ii) contacting the isolated DCIS cancer cell proliferation DNA molecule with a bisulfite salt thereby forming a reacted DCIS cancer cell proliferation DNA molecule; and (iii) detecting the presence or absence of uracil in the reacted DCIS cancer cell proliferation DNA molecule at a methylation site set forth in Table 1, thereby detecting the risk for developing IDC in the subject. In embodiments, the method comprises (i) isolating a plurality of DCIS cancer cell proliferation deoxyribonucleic acid (DNA) molecules from DCIS tissue of the subject thereby forming a plurality of isolated DCIS cancer cell proliferation DNA molecules; (ii) contacting the plurality of isolated DCIS cancer cell proliferation DNA molecules with a bisulfite salt thereby forming a plurality of reacted DCIS cancer cell proliferation DNA molecules; and (iii) detecting the level of reacted DCIS cancer cell proliferation DNA molecules in the plurality of reacted DCIS cancer cell proliferation DNA molecules having a uracil at a plurality of methylation sites set forth in Table 1, thereby detecting the risk for IDC in the subject.

In embodiments, the detection of the presence, absence, or level of uracil in a reacted DCIS cancer cell proliferation DNA molecule at a methylation site set forth in Table 1 comprises amplifying the reacted DCIS cancer cell proliferation DNA molecule [e.g., by a polymerase chain reaction (PCR)] to produce an amplicon, and determining whether a thymidine is present at the nucleotide position of the amplicon that corresponds to the nucleotide position of the uracil in the reacted DCIS cancer cell proliferation DNA molecule.

Aspects also include a method of treating or preventing IDC a subject detected to have a risk of IDC or diagnosed as having IDC. In embodiments, the method includes administering to the subject a treatment to treat or prevent IDC or directing the subject to obtain treatment to treat or prevent IDC.

Also included herein is a DNA molecule at least 5 to 100 nucleotides in length comprising a uracil-containing sequence that is identical to a sequence of at least 5 contiguous nucleotides within a sequence chosen from SEQ ID NO:1 to SEQ ID NO:242.

In embodiments, provided herein is an oligonucleotide comprising a uracil-containing sequence that is identical to a sequence of at least 5-10, 10-20, 20-30, 30-40, 40-50, 50-60, 60-70, 70-80, 80-90, 90-100, 100-110, 110-120, 120-130, 130-140, 140-150, 150-160, 160-170, 170-180, 180-190, or 190-200 contiguous nucleotides within the sequence chosen from SEQ ID NO:1 to SEQ ID NO:242, or an oligonucleotide that is an amplicon or is identical to an amplicon of a methylation site-containing sequence of at least 5-10, 10-20, 20-30, 30-40, 40-50, 50-60, 60-70, 70-80, 80-90, 90-100, 100-110, 110-120, 120-130, 130-140, 140-150, 150-160, 160-170, 170-180, 180-190, or 190-200 contiguous nucleotides within the sequence chosen from SEQ ID NO:1 to SEQ ID NO:242.

Aspects of the present subject matter also include a deoxyribonucleic acid chosen from SEQ ID NO:243 to SEQ ID NO: 356, wherein the nucleic acid is hybridized to a complementary DNA sequence comprising uridine or cytosine.

Also provided is a kit comprising a plurality of nucleic acids each independently comprising SEQ ID NO: 242 to SEQ ID NO: 356, wherein each nucleic acid of the plurality is unique.

In embodiments, included herein is a system for detecting methylation or unmethylation of a DCIS cancer cell proliferation DNA molecule of a subject. In embodiments, the system provides at least one processor; and at least one memory including program code which when executed by the at least one processor provides operations comprising: contacting an isolated DCIS cancer cell proliferation DNA molecule from the subject with a bisulfate salt thereby forming a reacted DCIS cancer cell proliferation DNA molecule; detecting the presence or absence of uracil in the reacted DCIS cancer cell proliferation DNA molecule at a methylation site set forth in Table 1, thereby detecting methylation or unmethylation of the DCIS cancer cell proliferation DNA molecule of the subject; generating a diagnosis for the subject based at least in part on the presence or absence of uracil in the reacted DCIS cancer cell proliferation DNA molecule at the methylation site set forth in Table 1; and providing, via a user interface, the diagnosis or prognosis for the subject. In embodiments, the system provides at least one processor; and at least one memory including program code which when executed by the at least one processor provides operations comprising: contacting the plurality of isolated DCIS cancer cell proliferation DNA molecules with a bisulfite salt thereby forming a plurality of reacted DCIS cancer cell proliferation DNA molecules; detecting the level of reacted DCIS cancer cell proliferation DNA molecules in the plurality of reacted DCIS cancer cell proliferation DNA molecules having a uracil at a methylation site set forth in Table 1 thereby detecting the level of methylation or unmethylation in the plurality of DCIS cancer cell proliferation DNA molecules of the subject; generating a diagnosis for the subject based at least in part on the level of methylation or unmethylation at the plurality of methylation sites set forth in Table 1; and providing, via a user interface, the diagnosis or prognosis for the subject.

Aspects also include a system for detecting methylation or unmethylation of a DCIS cancer cell proliferation DNA molecule of a subject. In embodiments, the system comprises at least one processor and at least one memory including program code which when executed by the at least one processor provides operations. In embodiments, the operations comprise (i) isolating a DCIS cancer cell proliferation DNA molecule from a DCIS cancer cell proliferation of the subject thereby forming an isolated DCIS cancer cell proliferation DNA molecule; (ii) contacting the isolated DCIS cancer cell proliferation DNA molecule with a bisulfite salt thereby forming a reacted DCIS cancer cell proliferation DNA molecule; (iii) detecting the presence or absence of uracil in the reacted DCIS cancer cell proliferation DNA molecule at a methylation site set forth in Table 1, thereby detecting methylation or unmethylation of the DCIS cancer cell proliferation DNA molecule of the subject; (iv) generating a diagnosis for the subject based at least in part on the presence or absence of uracil in the reacted DCIS cancer cell proliferation DNA molecule at the methylation site set forth in Table 1; and (v) providing, via a user interface, the diagnosis or prognosis for the subject.

Also provided herein is a system for detecting methylation or unmethylation of a plurality of DCIS cancer cell proliferation DNA molecules of a subject. In embodiments, the system comprises at least one processor and at least one memory including program code which when executed by the at least one processor provides operations. In embodiments, the operations comprise (i) isolating a plurality of DCIS cancer cell proliferation DNA molecules from the DCIS cancer cell proliferation of the subject thereby forming a plurality of isolated DCIS cancer cell proliferation DNA molecules; (ii) contacting the plurality of isolated DCIS cancer cell proliferation DNA molecules with a bisulfate salt thereby forming a plurality of reacted DCIS cancer cell proliferation DNA molecules; (iii) detecting the level of reacted DCIS cancer cell proliferation DNA molecules in the plurality of reacted DCIS cancer cell proliferation DNA molecules having a uracil at a methylation site set forth in Table 1 thereby detecting the level of methylation or unmethylation in the plurality of DCIS cancer cell proliferation DNA molecules of the subject; (iv) generating a diagnosis for the subject based at least in part on the level of methylation or unmethylation at the plurality of methylation sites set forth in Table 1; and (v) providing, via a user interface, the diagnosis or prognosis for the subject.

BRIEF DESCRIPTION OF THE DRAWINGS

FIG. 1C is a table, FIG. 1A: Extraction of cancer cells from DCIS containing ducts. DCIS slide before and after a laser cut. FIG. 1B: DNA methylation patterns at promoters in DCIS. Heatmap was done for promoter regions with available DNA methylation information (20,910 regions). The depicted scale represents levels of methylation, with −10.00 being low and 10.00 being high. FIG. 1C: Pathology data for the samples included in the study. FIG. 1D: DNA methylation status of 140 cytosines separates "invasion incompetent" and "invasion competent" DCIS. Lighter shading represents low level of DNA methylation, darker shading indicates a high level of DNA methylation. "ER" means "estrogen receptor" and "PR" means "progesterone receptor." (+) means positive for estrogen and progesterone receptor staining. (−) means negative for estrogen and progesterone receptor staining. DCIS_IDC_11, DCIS_IDC_13(+), and DCIS_IDC_14(+) are samples from patients with DCIS with adjacent IDC. DCIS_3(−) and DCIS_6(−), INV, are samples from patients without IDC with DCIS negative for estrogen and progesterone receptor staining. DCIS_4, DCIS_5(+), DCIS_7(+), DCIS_8(+), and DCIS_1(+) are samples from patients without IDC with DCIS positive for estrogen and progesterone receptor staining (with the exception that status of estrogen receptor and progesterone receptor staining is not known for the DCIS_4).

DETAILED DESCRIPTION OF THE INVENTION

Figure 1A:
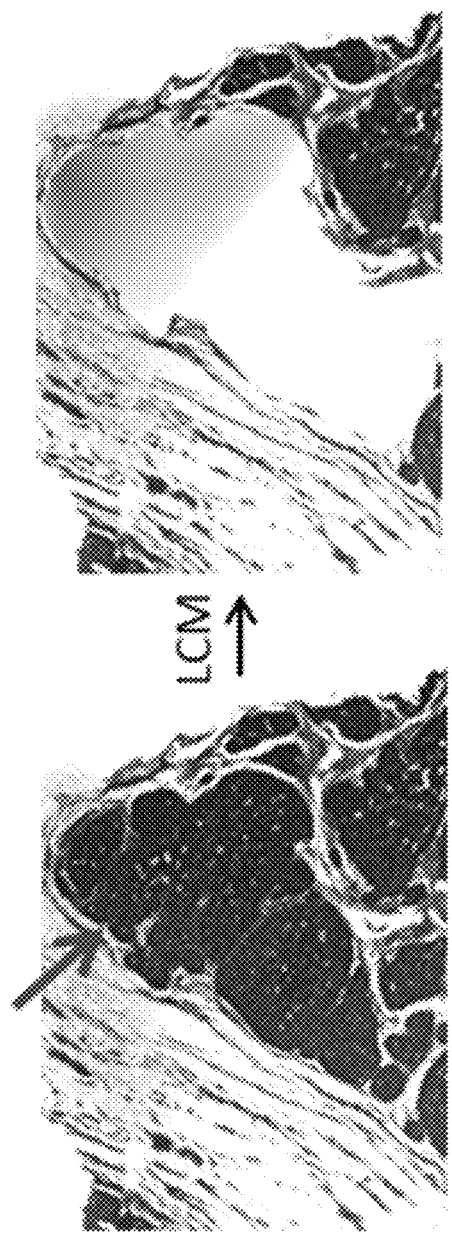
FIG. 1A is a set of images.
Figure 1B:
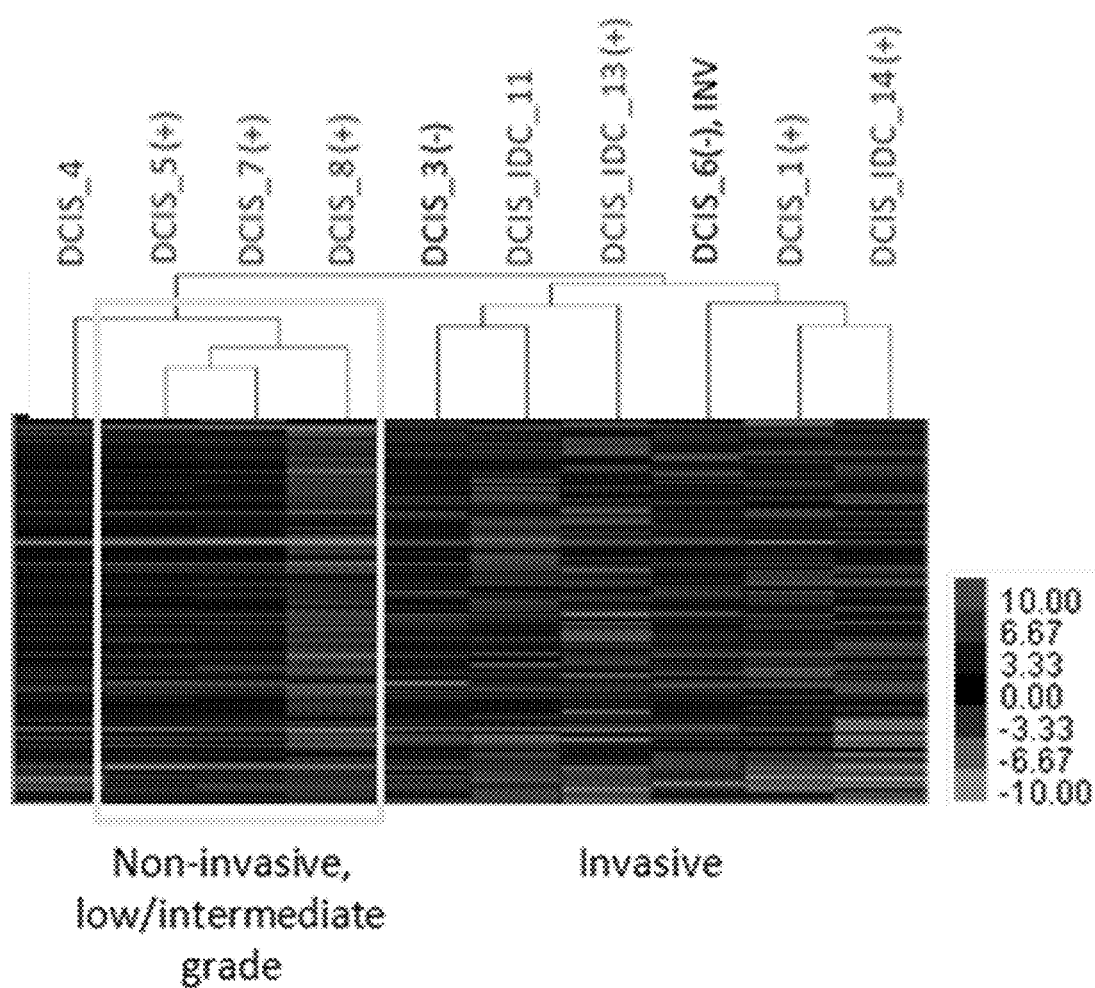
FIGS. 1B and 1D are heatmap images relating to the epigenetic analysis of DCIS.

Provided herein are, inter alia, compositions, methods, and kits for detecting methylated and/or unmethylated DNA. In some aspects, the present disclosure includes compositions, methods, and kits for detecting methylated and/or unmethylated DNA from ductal carcinoma in situ.

The following definitions are included for the purpose of understanding the present subject matter and for constructing the appended patent claims. Abbreviations used herein have their conventional meaning within the chemical and biological arts.

Definitions

Unless specifically defined otherwise, all technical and scientific terms used herein shall be taken to have the same meaning as commonly understood by one of ordinary skill in the art (e.g., in oncology, cell culture, molecular genetics, epigenetics, and biochemistry).

As used herein, the term "about" in the context of a numerical value or range means±10% of the numerical value or range recited or claimed, unless the context requires a more limited range.

In the descriptions above and in the claims, phrases such as "at least one of" or "one or more of" may occur followed by a conjunctive list of elements or features. The term "and/or" may also occur in a list of two or more elements or features. Unless otherwise implicitly or explicitly contradicted by the context in which it is used, such a phrase is intended to mean any of the listed elements or features individually or any of the recited elements or features in combination with any of the other recited elements or features. For example, the phrases "at least one of A and B;" "one or more of A and B;" and "A and/or B" are each intended to mean "A alone, B alone, or A and B together." A similar interpretation is also intended for lists including three or more items. For example, the phrases "at least one of A, B, and C;" "one or more of A, B, and C;" and "A, B, and/or C" are each intended to mean "A alone, B alone, C alone, A and B together, A and C together, B and C together, or A and B and C together." In addition, use of the term "based on," above and in the claims is intended to mean, "based at least in part on," such that an unrecited feature or element is also permissible.

It is understood that where a parameter range is provided, all integers within that range, and tenths thereof, are also provided by the invention. For example, "0.2-5 mg" discloses 0.2 mg, 0.3 mg, 0.4 mg, 0.5 mg, 0.6 mg etc. up to and including 5.0 mg. Additionally, where two values for a parameter are disclosed, then a range of all values between and including those two values is also disclosed. For example, "1, 2, and 3" discloses, e.g., 1-2, 1-3, and 2-3.

A small molecule is a compound that is less than 2000 daltons in mass. The molecular mass of the small molecule is preferably less than 1000 daltons, more preferably less than 600 daltons, e.g., the compound is less than 500 daltons, 400 daltons, 300 daltons, 200 daltons, or 100 daltons.

The term "ductal carcinoma in situ cancer cell proliferation" (also recited as "DCIS cancer cell proliferation" herein) refers to a biological sample comprising one or more cells obtained or provided from DCIS tissue of a subject. In embodiments, the DCIS cancer cell proliferation comprises a biopsy taken, e.g., from an abnormality [such as mammographic or magnetic resonance imaging (MRI) abnormality] in the breast of a subject. Non-limiting examples of mammographic abnormalities may include or be referred to as suspicious calcifications, microcalcifications, clustered microcalcifications, pleomorphic calcifications, pleomorphic branching calcifications, or a cluster of heterogeneous calcifications. In embodiments, a mammographic abnormality is observed as a mass. In embodiments, the mammographic abnormality is other than a mass (e.g., is a proliferation of cells within or along a duct in a string, sheet, plurality, or population of cells). Non-limiting examples of breast MRI abnormalities may include or be referred to as an abnormal enhancement, a mass-like enhancement, a non-mass enhancement, a linear non-mass enhancement, an enhancing intraductal mass, or a suspicious enhancing lesion. In embodiments, an MRI abnormality or enhancement is observed as a mass. In embodiments, during a breast MRI, mammogram, ultrasound, or physical exam, a DCIS cancer cell proliferation presents as a string, sheet, plurality, or population of cells, a mass, an irregular mass, or a mass lesion, or by ultrasound as a hypoechoic mass. In embodiments, the DCIS cancer cell proliferation is substantially free of normal cells. For example, at least about 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9%, or more of the cells in the DCIS cancer cell proliferation are dysplastic cells such as DCIS cells. In embodiments, at least 75% of the cells in the DCIS cancer cell proliferation are DCIS cancer cells.

The term "disease" refers to any deviation from the normal health of a mammal and includes a state when disease symptoms are present, as well as conditions in which a deviation (e.g., infection, gene mutation, genetic defect, etc.) has occurred, but symptoms are not yet manifested. According to the present disclosure, the methods disclosed herein are suitable for use in a patient that is a member of the Vertebrate class, Mammalia, including, without limitation, primates, livestock and domestic pets (e.g., a companion animal). Typically, a patient will be a human patient.

The terms "subject," "patient," "individual," and the like as used herein are not intended to be limiting and can be generally interchanged. That is, an individual described as a "patient" does not necessarily have a given disease, but may be merely seeking medical advice.

The term "subject" as used herein includes any mammal. In embodiments, the subject is a primate such as a human. In embodiments, the subject is a female. In embodiments, the subject is a male. Non-limiting examples of mammals include rodents (e.g., mice and rats), elephants, sloths, armadillos, primates (such as lemurs, bushbabies, monkeys, apes, and humans), rabbits, dogs (e.g., pets or work dogs such as police dogs, military dogs, race dogs, or show dogs), horses (such as race horses and work horses), donkeys, zebras, tapirs, rhinoceroses, cats (e.g., domesticated cats and large cats such as lions, cheetahs, tigers, and leopards), whales, dolphins, porpoises, pigs, cattle, and deer.

It must be noted that as used herein and in the appended embodiments, the singular forms "a," "an," and "the" include the plural reference unless the context clearly dictates otherwise. Thus, for example, a reference to "a disease," "a disease state", "a nucleic acid" or "a CpG site" is a reference to one or more such embodiments, and includes equivalents thereof known to those skilled in the art and so forth.

The transitional term "comprising," which is synonymous with "including," "containing," or "characterized by," is inclusive or open-ended and does not exclude additional, unrecited elements or method steps. By contrast, the transitional phrase "consisting of" excludes any element, step, or ingredient not specified in the claim. The transitional phrase "consisting essentially of" limits the scope of a claim to the specified materials or steps "and those that do not materially affect the basic and novel characteristic(s)" of the claimed invention.

A "control" sample or value refers to a sample that serves as a reference, usually a known reference, for comparison to a test sample. For example, a test sample can be taken from a patient suspected or at risk of having breast cancer and compared to samples from a known breast cancer patient, or a known normal (non-disease) individual. A control can also represent an average value gathered from a population of similar individuals, e.g., breast cancer patients or healthy individuals with a similar medical background, same age, weight, etc. A control value can also be obtained from the same individual, e.g., from an earlier-obtained sample, prior to disease, or prior to treatment. One of skill will recognize that controls can be designed for assessment of any number of parameters.

One of skill in the art will understand which controls are valuable in a given situation and be able to analyze data based on comparisons to control values. Controls are also valuable for determining the significance of data. For example, if values for a given parameter are widely variant in controls, variation in test samples will not be considered as significant.

As used herein, the term "diagnosing" and the like includes detecting a disease, disorder, and/or a symptom or feature (e.g., invasiveness) thereof. Diagnosing also includes determining the stage or degree of a disease or disorder. The term "prognosis" refers to a relative probability that a certain future outcome may occur in the subject. For example, in the context of the present disclosure, prognosis can refer to the likelihood that an individual will develop a disease, or the likely severity of the disease (e.g., severity of symptoms, rate of functional decline, survival, invasiveness, etc.). The terms are not intended to be absolute, as will be appreciated by any one of skill in the field of medical diagnostics.

"Treating" or "treatment" of a condition as used herein includes preventing or alleviating a condition, slowing the onset or rate of development of a condition, reducing the risk of developing a condition, preventing or delaying the development of symptoms associated with a condition, reducing or ending symptoms associated with a condition, generating a complete or partial regression of a condition, curing a condition, or some combination thereof. With regard to cancer, "treating" or "treatment" may refer to inhibiting or slowing neoplastic or malignant cell growth, proliferation, invasion, or metastasis, preventing or delaying the development of neoplastic or malignant cell growth, proliferation, invasion, or metastasis, or some combination thereof. With regard to a tumor, "treating" or "treatment" includes eradicating all or part of a tumor, inhibiting or slowing tumor growth, invasion, and metastasis, preventing or delaying the development of a tumor, or some combination thereof.

As used herein, a "symptom" associated with a disorder includes any clinical or laboratory manifestation associated with the disorder, and is not limited to what the subject can feel or observe.

"Nucleic acid" or "oligonucleotide" or "polynucleotide" or grammatical equivalents used herein means at least two nucleotides covalently linked together. Oligonucleotides are typically from about 5, 6, 7, 8, 9, 10, 12, 15, 25, 30, 40, 50 or more nucleotides in length, up to about 100 nucleotides in length. Nucleic acids, including ribonucleic acids (RNA) and deoxyribonucleic acids (DNA), and polynucleotides are a polymers of any length, including longer lengths, e.g., 200, 300, 500, 1000, 2000, 3000, 5000, 7000, 10,000, etc. A nucleic acid of the present invention will generally contain phosphodiester bonds, although in some cases, nucleic acid analogs are included that may have alternate backbones, comprising, e.g., phosphoramidate, phosphorothioate, phosphorodithioate, or O-methylphosphoramidite linkages (see Eckstein, Oligonucleotides and Analogues: A Practical Approach, Oxford University Press); and peptide nucleic acid backbones and linkages. Other analog nucleic acids include those with positive backbones; non-ionic backbones, and non-ribose backbones, including those described in U.S. Pat. Nos. 5,235,033 and 5,034,506, and Chapters 6 and 7, ASC Symposium Series 580, Carbohydrate Modifications in Antisense Research, Sanghui & Cook, eds. Nucleic acids containing one or more carbocyclic sugars are also included within one definition of nucleic acids. Modifications of the ribose-phosphate backbone may be done for a variety of reasons, e.g., to increase the stability and half-life of such molecules in physiological environments or as probes on a biochip. Mixtures of naturally occurring nucleic acids and analogs can be made; alternatively, mixtures of different nucleic acid analogs, and mixtures of naturally occurring nucleic acids and analogs may be made.

The term "bp" and the like refer, in the usual and customary sense, to the indicated number of base pairs.

The terms "identical" or percent "identity," in the context of two or more nucleic acids (e.g., genomic sequences or subsequences or coding sequences) or polypeptide sequences, refer to two or more sequences or subsequences that are the same or have a specified percentage of amino acid residues or nucleotides that are the same (i.e., 50%, 55%, 60%, 65%, 70%, 75%, 80%, 85%, 90%, 91%, 92%, 93%, 94%, 95%, 96%, 97%, 98%, 99%, or more identity over a specified region), when compared and aligned for maximum correspondence over a comparison window, or designated region as measured using one of the following sequence comparison algorithms or by manual alignment and visual inspection. Such sequences are then said to be "substantially identical." This definition also refers to the compliment of a test sequence. Optionally, the identity exists over a region that is at least about 10 to about 100, about 20 to about 75, about 30 to about 50 amino acids or nucleotides in length.

An example of algorithms suitable for determining percent sequence identity and sequence similarity are the BLAST and BLAST 2.0 algorithms, which are described in Altschul et al., Nuc. Acids Res. 25:3389-3402 (1977) and Altschul et al., J. Mol. Biol. 215:403-410 (1990), respectively. As will be appreciated by one of skill in the art, the software for performing BLAST analyses is publicly available through the website of the National Center for Biotechnology Information.

A "label" or a "detectable moiety" is a composition detectable by spectroscopic, photochemical, biochemical, immunochemical, chemical, or other physical means. For example, useful labels include $^{32}$P, fluorescent dyes, electron-dense reagents, enzymes (e.g., as commonly used in an ELISA), biotin, digoxigenin, or haptens and proteins or other entities which can be made detectable, e.g., by incorporating a radiolabel into a peptide or antibody specifically reactive with a target peptide. Any method known in the art for conjugating an antibody to the label may be employed, e.g., using methods described in Hermanson, Bioconjugate Techniques 1996, Academic Press, Inc., San Diego.

The term "associated" or "associated with" in the context of a substance (e.g., level of uracil or methylation level in a breast lump or DCIS cancer cell proliferation) does not necessarily mean that the disease is caused by (in whole or in part), or a symptom of the disease is caused by (in whole or in part) the substance or substance activity or function (i.e., level of uracil in the regions of chromosomes assayed).

The term "unmethylated DNA" or "demethylated DNA" means DNA that lacks a methyl group conjugated to cytosine in a segment of the DNA. DNA methylation typically occurs in a CpG dinucleotide context. In the context of the present disclosure, the DNA can be equivalent to a short (2-50, 5-50, 2-300, 2-350 nucleotides, e.g. 5-350 nucleotides) double stranded or single stranded nucleic acid, a nucleic acid fragment cloned in a plasmid DNA, a nucleic acid fragment amplified from a sample of a subject, and/or synthetically prepared a nucleic acid fragment. DNA methylation at the 5' position of cytosine may have the specific effect on gene expression in vivo. DNA methylation may also form the basis of epigenetic structure, which typically enables a single cell to grow into multiple organs or perform multiple functions.

The CpG sites or CG sites are regions of DNA where a cytosine nucleotide occurs next to a guanine nucleotide in the linear sequence of bases along its length. "CpG" is shorthand for "-C-phosphate-G-", that is, cytosine and guanine separated by only one phosphate; phosphate links any two nucleosides together in DNA. The "CpG" notation is used to distinguish this linear sequence from the CG base-pairing of cytosine and guanine. The CpG notation can also be interpreted as the cytosine being 5' prime to the guanine base.

In embodiments, methylation is detected based on a chemical reaction of sodium bisulfite with DNA that converts unmethylated cytosines of CpG dinucleotides to uracil or UpG. However, methylated cytosine is not converted in this process, the methods of the present disclosure allow determination of methylation status as methylated or unmethylated.

As used herein, an "isolated" or "purified" nucleic acid molecule, polynucleotide, polypeptide, or protein, is substantially free of other cellular material, or culture medium when produced by recombinant techniques, or chemical precursors or other chemicals when chemically synthesized. Purified compounds are at least 60% by weight (dry weight) the compound of interest. Preferably, the preparation is at least 75%, more preferably at least 90%, and most preferably at least 99%, by weight the compound of interest. For example, a purified compound is one that is at least 90%, 91%, 92%, 93%, 94%, 95%, 98%, 99%, or 100% (w/w) of the desired compound by weight. Purity is measured by any appropriate standard method, for example, by column chromatography, thin layer chromatography, or high-performance liquid chromatography (HPLC) analysis. A purified or isolated polynucleotide [ribonucleic acid (RNA) or deoxyribonucleic acid (DNA)] is free of the genes or sequences that flank it in its naturally-occurring state. Purified also defines a degree of sterility that is safe for administration to a human subject, e.g., lacking infectious or toxic agents.

Similarly, by "substantially pure" is meant a nucleotide or polypeptide that has been separated from the components that naturally accompany it. Typically, the nucleotides and polypeptides are substantially pure when they are at least 60%, 70%, 80%, 90%, 95%, or even 99%, by weight, free from the proteins and naturally-occurring organic molecules with they are naturally associated.

Exemplary Epigenetic Signatures

DCIS is the most common type of non-invasive breast cancer. Ductal means that the cancer starts inside the milk ducts (which are the "pipes" that carry milk from the milk-producing lobules to the nipple), carcinoma refers to any cancer arising in the epithelial tissue of the skin or of the lining of the internal organs (including breast tissue), and in situ means "in its original place." DCIS is called "non-invasive" because it hasn't spread beyond the milk duct into any normal surrounding breast tissue. However, as disclosed herein, DCIS may be predisposed or prone to becoming invasive. DCIS is frequently found to be associated with invasive cancer where the DCIS remains localized in the ducts while the adjacent invasive cancer invades out of the ducts. IDC, which stands for infiltrating ductal carcinoma or invasive ductal carcinoma, is the most common type of invasive breast cancer. Invasive means that the cancer "invades" or spreads to surrounding tissues (e.g., surrounding breast tissues). All together, "invasive ductal carcinoma" refers to cancer that has broken through the wall of the milk duct and invaded the tissues of the breast. Over time, invasive ductal carcinoma can spread to the lymph nodes and possibly to other areas of the body.

Provided herein are methods, compounds, compositions, kits, and systems for detecting invasive competent DCIS and invasive incompetent DCIS in a subject who has DCIS, treating breast cancer in a subject detected to have invasive competent DCIS or invasive incompetent DCIS, monitoring a subject who has DCIS for invasive competent DCIS, and distinguishing invasive competent DCIS from invasive incompetent DCIS in a subject.

In an aspect, included herein are molecular epigenetic diagnostic methods that reduce breast cancer overdiagnosis and overtreatment. In embodiments, the treatment of a subject differs based on whether the subject is determined to have IDC or a risk for IDC. For example, a subject determined to have IDC or a risk of IDC may receive surgery such as a mastectomy, whereas a subject determined to not have IDC or no risk of IDC may receive less invasive surgery, radiation therapy, hormonal therapy, or be monitored periodically (e.g., retested for IDC, or IDC risk according to a method disclosed herein at a future time point, such as 0.5-5 years from the initial test) without receiving surgery, chemotherapy, radiation therapy, or hormonal therapy.

In embodiments, DCIS can be classified into two groups. One group comprises DCIS from patients with potential or concomitant invasion and characterized by cancer specific DNA methylation changes ("invasion competent DCIS" or "IC-DCIS"), the second group with DCIS is without any invasive disease ("invasion incompetent DCIS" or "II-DCIS") and associated with DNA methylation pattern more similar to normal cells. IC-DCIS has a risk of becoming invasive in the future. In embodiments, a subject with IC-DCIS may have a substantial risk (e.g., at least a 10%, 20%, 30%, 40%, or 50% chance) of having IDC (e.g., within about 1, 2, 3, 4, 5, or 10 years).

Not to be bound by theory, it is hypothesized that there are two different epigenetic programs driving DCIS progression, and patients with the "invasion incompetent" signature are not at risk of developing invasive ductal cancer over time while patients with DCIS from the second epigenetic group having "invasion competent" signature will have a very high chance to develop invasive ductal cancer.

In embodiments, provided herein are epigenetic biomarkers based on DNA methylation that detect DCIS invasive state or potential and/or predict DCIS progression to an invasive state. In embodiments, the DNA methylation of cells in a sample obtained or provided from a subject is detected. In embodiments, the sample comprises DCIS-containing cancer cells isolated by a laser capture procedure from a biopsy. In embodiments, the sample comprises a DCIS cancer cell proliferation that is substantially free of normal cells. For example, at least about 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9%, or more of the cells in the DCIS cancer cell proliferation are dysplastic cells (e.g., breast cancer cells such as DCIS cells). In embodiments, the DCIS cancer cell proliferation comprises cancer cells isolated by a laser capture procedure from a biopsy. In embodiments, the DCIS cancer cell proliferation is isolated by surgical excision followed by cancer cell purification by using a laser capture procedure. In embodiments, the DCIS cancer cell proliferation is isolated directly from a subject or from a sample that was previously obtained from the subject. In embodiments, the DCIS cancer cell proliferation is obtained or provided from a section of tissue that has been obtained or provided from the subject. In embodiments, the tissue comprises tissue from a mammographic abnormality or lump in the breast of a subject that comprises or is suspected of comprising breast cancer cells such as DCIS cells. In embodiments, the DCIS cancer cell proliferation is obtained or provided from a tissue section, e.g. a slice or section or a sample that has been stained for DNA and protein detection such as a slice or section that has been mounted on a slide. In embodiments, the DCIS cancer cell proliferation is isolated or captured from a paraffin-embedded sample slide using, e.g., a laser. In embodiments, DNA methylation of at least about 1, 2, 3, 4, 5, 6, 7, 8, 9, 10, 20, 25, 50, 75, 100, 125, or 140, or 1-50, 1-100, 1-140, 50-100, or 50-140 (inclusive) of the sites in Table 1 identifies the DCIS of a subject as IC-DCIS or II-DCIS.

Method of Detection Methylation Status of a Ductal Carcinoma DNA

In an aspect, provided herein is a method for detecting the presence, absence, and/or level of methylation at one or more sites set forth in Table 1. In embodiments, the level of methylation at a site set forth in Table 1 is detected. In embodiments, determining the level of methylation comprises bisulfite salt treatment, methyl-sensitive cut counting, and/or any method for a single base DNA methylation detection.

In an aspect, included herein is method of detecting methylation or unmethylation of a DCIS cell DNA molecule of a subject. In embodiments, the method comprises (i) contacting an isolated DCIS cancer cell proliferation DNA molecule from the subject with a bisulfite salt thereby forming a reacted DCIS cancer cell proliferation DNA molecule; and (ii) detecting the presence or absence of uracil in the reacted DCIS cancer cell proliferation DNA molecule at a methylation site set forth in Table 1, thereby detecting methylation or unmethylation of the DCIS cancer cell proliferation DNA molecule of the subject.

In embodiments, the present disclosure provides a method of detecting methylation or unmethylation of a breast lump DNA molecule of a subject, the method including: (i) isolating DNA from cancer cells obtained from a mammographic or MRI ductal abnormality, a breast nodule, a tumor, or a lump of said subject (e.g., a DCIS cancer cell proliferation or tissue) thereby forming an isolated DNA molecule, (ii) contacting said isolated DNA molecule with a bisulfite salt (such as sodium bisulfite) thereby forming a reacted DNA molecule, (iii) detecting the presence or absence of uracil in said reacted DNA molecule at a methylation site set forth in Table 1, thereby detecting methylation or unmethylation of said DNA molecule of said subject.

In an aspect, provided herein is a method of detecting methylation or unmethylation of a DCIS cancer cell proliferation DNA of a subject. The method includes: (i) isolating a DCIS cancer cell proliferation DNA molecule from a DCIS cancer cell proliferation of the subject thereby forming an isolated DCIS cancer cell proliferation DNA molecule, (ii) contacting the isolated DCIS cancer cell proliferation DNA molecule with a bisulfite salt (such as sodium bisulfite) thereby forming a reacted DCIS cancer cell proliferation DNA molecule, (iii) detecting the presence or absence of uracil in the reacted DCIS cancer cell proliferation DNA molecule at a methylation site set forth in Table 1, thereby detecting methylation or unmethylation of the DCIS cancer cell proliferation DNA molecule of the subject. In embodiments, contacting the isolated DCIS cancer cell proliferation DNA with a bisulfite salt comprises adding a solution comprising the bisulfite salt to a solution comprising the isolated single stranded DNA.

In embodiments, the method of detecting methylation or unmethylation of a DCIS DNA molecule of a subject, includes determining alteration (e.g., compared to normal or II-DCIS cancer cell proliferation DNA) in methylation at a plurality of methylation sites set forth in Table 1.

Also provided herein is a method of detecting methylation or unmethylation of a plurality of DCIS cancer cell proliferation DNA molecules of a subject. In embodiments, the method comprises (i) contacting a plurality of isolated DCIS cancer cell proliferation DNA molecules from the subject with a bisulfite salt thereby forming a plurality of reacted DCIS cancer cell proliferation DNA molecules; and (ii) detecting the level of uracil in the plurality of reacted DCIS cancer cell proliferation DNA molecules at a plurality of methylation sites set forth in Table 1, thereby detecting the level of methylation or unmethylation in the plurality of DCIS cancer cell proliferation DNA molecules of the subject.

In an aspect, provided herein is a method of detecting methylation or unmethylation of a plurality of DCIS cancer cell proliferation DNA molecules of a subject comprising (i) isolating a plurality of DCIS cancer cell proliferation DNA molecules from the DCIS cancer cell proliferation of the subject thereby forming a plurality of isolated DCIS cancer cell proliferation DNA molecules, (ii) contacting the plurality of isolated DCIS cancer cell proliferation DNA molecules with the bisulfite salt thereby forming a plurality of reacted DCIS cancer cell proliferation DNA molecules, (iii) detecting the level of reacted DCIS cancer cell proliferation DNA molecules in the plurality of reacted DCIS cancer cell proliferation DNA molecules having a uracil at a plurality of methylation sites set forth in Table 1, thereby detecting the level of methylation or unmethylation in the plurality of DCIS cancer cell proliferation DNA molecules of the subject.

In an aspect, provided herein is a method of detecting methylation or unmethylation of a plurality of DCIS cancer cell proliferation DNA molecules of a subject comprising (i) isolating a plurality of DCIS cancer cell proliferation DNA molecules from the DCIS cancer cell proliferation of the subject thereby forming a plurality of isolated DCIS cancer cell proliferation DNA molecules, (ii) contacting the plurality of isolated DCIS cancer cell proliferation DNA molecules with the bisulfite salt thereby forming a plurality of reacted DCIS cancer cell proliferation DNA molecules, (iii) plurality of reacted DCIS cancer cell proliferation DNA molecules having a uracil at a plurality of methylation sites set forth in Table 1, thereby detecting methylation or unmethylation in the plurality of DCIS cancer cell proliferation DNA molecules of the subject.

In an aspect, provided herein is a method of detecting methylation or unmethylation of a DCIS cancer cell proliferation DNA molecule of a subject. The method includes: (i) contacting an isolated DCIS cancer cell proliferation DNA molecule from the subject with a bisulfite salt (such as sodium bisulfite) thereby forming a reacted DCIS cancer cell proliferation DNA molecule, (ii) amplifying the reacted DCIS cancer cell proliferation DNA molecule thereby forming a reacted DCIS cancer cell proliferation DNA amplicon molecule, (iii) detecting the presence or absence of thymidine in a reacted DCIS cancer cell proliferation DNA amplicon molecule at a methylation site set forth in Table 1, thereby detecting methylation or unmethylation of the DCIS cancer cell proliferation DNA molecule of the subject. In embodiments, contacting the isolated DCIS cancer cell proliferation DNA with a bisulfite salt comprises adding a solution comprising the bisulfite salt to a solution comprising the isolated single stranded DNA.

In an aspect, provided herein is a method of detecting methylation or unmethylation of a DCIS cancer cell proliferation DNA molecule of a subject. The method includes: (i) isolating a DCIS cancer cell proliferation DNA molecule from a DCIS cancer cell proliferation of the subject thereby forming an isolated DCIS cancer cell proliferation DNA molecule, (ii) contacting the isolated DCIS cancer cell proliferation DNA molecule with a bisulfite salt (such as sodium bisulfite) thereby forming a reacted DCIS cancer cell proliferation DNA molecule, (iii) amplifying the reacted DCIS cancer cell proliferation DNA molecule thereby forming a reacted DCIS cancer cell proliferation DNA amplicon molecule, (iv) detecting the presence or absence of thymidine in a reacted DCIS cancer cell proliferation DNA amplicon molecule at a methylation site set forth in Table 1, thereby detecting methylation or unmethylation of the DCIS cancer cell proliferation DNA molecule of the subject. In embodiments, contacting the isolated DCIS cancer cell proliferation DNA with a bisulfite salt comprises adding a solution comprising the bisulfite salt to a solution comprising the isolated single stranded DNA.

In an aspect, provided herein is a method of detecting methylation or unmethylation of a plurality of DCIS cancer cell proliferation DNA molecules of a subject comprising (i) contacting a plurality of isolated cancer DCIS cancer cell proliferation DNA molecules from a subject with a bisulfite salt thereby forming a plurality of reacted DCIS cancer cell proliferation DNA molecules, (ii) amplifying the plurality of reacted DCIS cancer cell proliferation DNA molecules thereby forming a plurality of reacted DCIS cancer cell proliferation DNA amplicon molecules, (iii) detecting one or more DCIS cancer cell proliferation DNA amplicon molecules within the plurality of reacted DCIS cancer cell proliferation DNA amplicon molecules having a thymidine at a methylation site set forth in Table 1, thereby detecting methylation or unmethylation of the plurality of DCIS cancer cell proliferation DNA molecules of the subject.

In an aspect, provided herein is a method of detecting methylation or unmethylation of a plurality of DCIS cancer cell proliferation DNA molecules of a subject comprising (i) isolating a plurality of DCIS cancer cell proliferation DNA molecules from the DCIS cancer cell proliferation of the subject thereby forming a plurality of isolated DCIS cancer cell proliferation DNA molecules, (ii) contacting the plurality of isolated DCIS cancer cell proliferation DNA molecules with a bisulfite salt thereby forming a plurality of reacted DCIS cancer cell proliferation DNA molecules, (iii) amplifying the plurality of reacted DCIS cancer cell proliferation DNA molecules thereby forming a plurality of reacted DCIS cancer cell proliferation DNA amplicon molecules, (iv) detecting one or more DCIS cancer cell proliferation DNA amplicon molecules within the plurality of reacted DCIS cancer cell proliferation DNA amplicon molecules having a thymidine at a methylation site set forth in Table 1, thereby detecting methylation or unmethylation of the plurality of DCIS cancer cell proliferation DNA molecules of the subject.

In embodiments, detecting one or more DCIS cancer cell proliferation DNA amplicon molecules comprises detecting the level of one or more one or more DCIS cancer cell proliferation DNA amplicon molecules. In embodiments, detecting one or more DCIS cancer cell proliferation DNA amplicon molecules comprises detecting the level of reacted DCIS cancer cell proliferation DNA amplicon molecules in the plurality of reacted DCIS cancer cell proliferation DNA amplicon molecules having a thymidine at a methylation site set forth in Table 1, thereby detecting the level of methylation or unmethylation in the plurality of DCIS cancer cell proliferation DNA molecules of the subject.

In embodiments, detecting a level includes determining the number (e.g. quantitating) or molecules having, e.g., a thymidine or a uracil. In embodiments, detecting a level includes detecting the portion or proportion of a population or plurality of molecules having, e.g., a thymidine or a uracil.

In embodiments, the isolated DCIS cancer cell proliferation DNA sample is treated with a bisulfite reagent, e.g., a bisulfite salt (i.e., a process called DNA bisulfite conversion). Non-limiting examples of bisulfite salts include sodium bisulfite, potassium bisulfite, ammonium bisulfite, magnesium bisulfite, sodium metabisulfite, potassium metabisulfite, ammonium metabisulfite and magnesium metabisulfite. Bisulfite salts such as sodium bisulfite or ammonium bisulfite can convert cytosine to uracil and leave 5-methylcytosine (5-mC) the same. Thus after bisulfite treatment methylated cytosine in the DNA remains the same and unmodified cytosines will be changed to uracil. The bisulfite treatment can be performed by using the methods disclosed herein or in the art, and/or with commercial kits such as the BisulFlash DNA Modification Kit (EpiGentek) and Imprint DNA Modification Kit (Sigma). For achieving the optimal bisulfite conversion, the bisulfite reaction should be carried out in an appropriate concentration of bisulfite reagents, appropriate temperature and appropriate reaction time period. A reagent such as potassium chloride that reduces thermophilic DNA degradation could also be used in bisulfite treatment so that the DNA bisulfite process can be much shorter without interrupting a completed conversion of unmethylated cytosine to uracil and without a significant thermodegradation of DNA resulted from depurination. In embodiments, a commercially available bisulfite treatment kit is used. A non-limiting example of such a kit is EZ DNA Methylation-Gold™ Kit (Zymo Research, Irvine, Calif., USA).

In embodiments, once DNA bisulfite conversion is complete, DNA is captured, desulphonated and washed. In embodiments, the bisulfite-treated DNA can be captured by, e.g., a solid matrix selected from silica salt, silica dioxide, silica polymers, magnetic beads, glass fiber, celite diatoms and nitrocellulose in the presence of high concentrations of chaotropic or non-chaotropic salts. In embodiments, the bisulfite-treated DNA is further desulphonated with an alkalized solution, preferably sodium hydroxide at concentrations from 10 mM to 300 mM. In embodiments, the DNA is then eluted and collected into a capped microcentrifuge tube. Non-limiting examples of elution solutions include DEPC-treated water and TE buffer (10 mM Tris-HCL, pH 8.0, and 1 mM EDTA).

In embodiments, the reacted DCIS cancer cell proliferation DNA resulting from bisulfite treatment is amplified. In embodiments, detecting the presence or absence of uracil in reacted DCIS cancer cell proliferation DNA molecule at a methylation site comprises amplifying the reacted DCIS cancer cell proliferation DNA molecule thereby forming a reacted DCIS cancer cell proliferation DNA amplicon molecule, and detecting the presence or absence of thymidine in a reacted DCIS cancer cell proliferation DNA amplicon molecule at the methylation site. In embodiments, a polymerase chain reaction (PCR) method is used for amplifying the reacted DCIS cancer cell proliferation DNA. PCR methods are known to those of ordinary skill in the art. In general, the PCR reactions can be set up by adding sample, dNTPs, and appropriate polymerase such as Taq polymerase, primers, and a buffer.

In embodiments, the method of detecting methylation or unmethylation of a DCIS cancer cell proliferation DNA of a subject, includes detecting methylation or unmethylation at a plurality of methylation sites set forth in Table 1. In embodiments, the plurality of methylation sites comprises at least about 2, 3, 4, 5, 10, 20, 30, 40, 50, 60, 70, 80, 80, 90, 100, 110, 120, 130, or 140 methylation sites. In embodiments, the plurality of methylation sites comprises less than about 140, 130, 120, 110, 100, 90, 80, 70, 60, 50, 40, 30, 20, or 10 methylation sites. In embodiments, the plurality of methylation sites is about 2, 3, 4, 5, 10, 25, 50, 75, 80, 85, 90, 100, 110, 120, 130, or 140 methylation sites. In embodiments, the plurality of methylation sites includes one, two, or more methylation sites set forth in Table 1 and no other methylation sites.

In embodiments, the method includes detecting methylation or unmethylation of at least 1, 2, 3, 4, 5, 6, 7, 8, 9, 10, 20, 30, 40, 50, 60, 70, 80, 90, 100, 110, 120, 130, or 140 of the following sites: Chromosome 1 (Chr1) position 4714314, Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chromosome 3 (Chr3) position 14852857, Chr3 position 121903470, Chr3 position 170303393, Chr3 position 170303422, Chr3 position 170303423, Chr3 position 170303424, Chr3 position 170303425, Chromosome 4 (Chr4) position 44449864, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chromosome 7 (Chr7) position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477232, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chromosome 12 (Chr12) position, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 95941925, Chr12 position 128750309, Chr12 position 129338355, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chromosome 19 (Chr19) position 30016170, Chr19 position 30017283, Chr19 position 30717013, Chr19 position 30719659, Chromosome 20 (Chr20) position 1294019, Chr20 position 3073503, Chr20 position 10198305, Chr20 position 23015989, Chr20 position 23016002, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, and Chromosome 22 position 43807517.

In embodiments, the method includes detecting methylation or unmethylation of at least 1 of the following sites: Chromosome 1 (Chr1) position 4714314, Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chromosome 3 (Chr3) position 14852857, Chr3 position 121903470, Chr3 position 170303393, Chr3 position 170303422, Chr3 position 170303423, Chr3 position 170303424, Chr3 position 170303425, Chromosome 4 (Chr4) position 44449864, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chromosome 7 (Chr7) position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477232, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chromosome 12 (Chr12) position, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 95941925, Chr12 position 128750309, Chr12 position 129338355, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chromosome 19 (Chr19) position 30016170, Chr19 position 30017283, Chr19 position 30717013, Chr19 position 30719659, Chromosome 20 (Chr20) position 1294019, Chr20 position 3073503, Chr20 position 10198305, Chr20 position 23015989, Chr20 position 23016002, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, and Chromosome 22 position 43807517.

In embodiments, the method includes detecting methylation or unmethylation of at least 5 of the following sites: Chromosome 1 (Chr1) position 4714314, Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chromosome 3 (Chr3) position 14852857, Chr3 position 121903470, Chr3 position 170303393, Chr3 position 170303422, Chr3 position 170303423, Chr3 position 170303424, Chr3 position 170303425, Chromosome 4 (Chr4) position 44449864, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chromosome 7 (Chr7) position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477232, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chromosome 12 (Chr12) position, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 95941925, Chr12 position 128750309, Chr12 position 129338355, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chromosome 19 (Chr19) position 30016170, Chr19 position 30017283, Chr19 position 30717013, Chr19 position 30719659, Chromosome 20 (Chr20) position 1294019, Chr20 position 3073503, Chr20 position 10198305, Chr20 position 23015989, Chr20 position 23016002, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, and Chromosome 22 position 43807517.

In embodiments, the method includes detecting methylation or unmethylation of at least 10 of the following sites: Chromosome 1 (Chr1) position 4714314, Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chromosome 3 (Chr3) position 14852857, Chr3 position 121903470, Chr3 position 170303393, Chr3 position 170303422, Chr3 position 170303423, Chr3 position 170303424, Chr3 position 170303425, Chromosome 4 (Chr4) position 44449864, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chromosome 7 (Chr7) position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477232, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chromosome 12 (Chr12) position, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 95941925, Chr12 position 128750309, Chr12 position 129338355, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chromosome 19 (Chr19) position 30016170, Chr19 position 30017283, Chr19 position 30717013, Chr19 position 30719659, Chromosome 20 (Chr20) position 1294019, Chr20 position 3073503, Chr20 position 10198305, Chr20 position 23015989, Chr20 position 23016002, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, and Chromosome 22 position 43807517.

In embodiments, the method includes detecting methylation or unmethylation of at least 50 of the following sites: Chromosome 1 (Chr1) position 4714314, Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chromosome 3 (Chr3) position 14852857, Chr3 position 121903470, Chr3 position 170303393, Chr3 position 170303422, Chr3 position 170303423, Chr3 position 170303424, Chr3 position 170303425, Chromosome 4 (Chr4) position 44449864, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chromosome 7 (Chr7) position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477232, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chromosome 12 (Chr12) position, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 95941925, Chr12 position 128750309, Chr12 position 129338355, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chromosome 19 (Chr19) position 30016170, Chr19 position 30017283, Chr19 position 30717013, Chr19 position 30719659, Chromosome 20 (Chr20) position 1294019, Chr20 position 3073503, Chr20 position 10198305, Chr20 position 23015989, Chr20 position 23016002, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, and Chromosome 22 position 43807517.

In embodiments, the method includes detecting methylation or unmethylation of at least 100 of the following sites: Chromosome 1 (Chr1) position 4714314, Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chromosome 3 (Chr3) position 14852857, Chr3 position 121903470, Chr3 position 170303393, Chr3 position 170303422, Chr3 position 170303423, Chr3 position 170303424, Chr3 position 170303425, Chromosome 4 (Chr4) position 44449864, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chromosome 7 (Chr7) position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477232, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chromosome 12 (Chr12) position, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 95941925, Chr12 position 128750309, Chr12 position 129338355, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chromosome 19 (Chr19) position 30016170, Chr19 position 30017283, Chr19 position 30717013, Chr19 position 30719659, Chromosome 20 (Chr20) position 1294019, Chr20 position 3073503, Chr20 position 10198305, Chr20 position 23015989, Chr20 position 23016002, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, and Chromosome 22 position 43807517.

In embodiments, the method includes detecting methylation or unmethylation of at least 120 of the following sites:

Chromosome 1 (Chr1) position 4714314, Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chromosome 3 (Chr3) position 14852857, Chr3 position 121903470, Chr3 position 170303393, Chr3 position 170303422, Chr3 position 170303423, Chr3 position 170303424, Chr3 position 170303425, Chromosome 4 (Chr4) position 44449864, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chromosome 7 (Chr7) position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477232, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chromosome 12 (Chr12) position, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 95941925, Chr12 position 128750309, Chr12 position 129338355, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chromosome 19 (Chr19) position 30016170, Chr19 position 30017283, Chr19 position 30717013, Chr19 position 30719659, Chromosome 20 (Chr20) position 1294019, Chr20 position 3073503, Chr20 position 10198305, Chr20 position 23015989, Chr20 position 23016002, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, and Chromosome 22 position 43807517.

In embodiments, the method includes detecting methylation or unmethylation of each of the following sites: Chromosome 1 (Chr1) position 4714314, Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chromosome 3 (Chr3) position 14852857, Chr3 position 121903470, Chr3 position 170303393, Chr3 position 170303422, Chr3 position 170303423, Chr3 position 170303424, Chr3 position 170303425, Chromosome 4 (Chr4) position 44449864, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chromosome 7 (Chr7) position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477232, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chromosome 12 (Chr12) position, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 95941925, Chr12 position 128750309, Chr12 position 129338355, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chromosome 19 (Chr19) position 30016170, Chr19 position 30017283, Chr19 position 30717013, Chr19 position 30719659, Chromosome 20 (Chr20) position 1294019, Chr20 position 3073503, Chr20 position 10198305, Chr20 position 23015989, Chr20 position 23016002, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, and Chromosome 22 position 43807517.

Aspects provide a method for monitoring whether the risk of IDC in a subject who has DCIS. In embodiments, a method provided herein is practiced for a subject more than once over time to determine whether the DCIS is progressing from II-DCIS to IC-DCIS or from IC-DCIS to IDC. In embodiments, the methylation of one or more methylation sites in a subject becomes less indicative of II-DCIS over time. In embodiments, the methylation of one or more methylation sites in a subject becomes more indicative of IC-DCIS over time. In embodiments, methylation or unmethylation of DCIS cancer cell proliferation DNA from a subject is assessed using a method provided herein at least 1, 2, 3, 4, 5, 6, 7, 8, 9, 10 or more times. In embodiments, the method is repeated at least once every 4, 6, 8, 12 or 18 months, or at least once every 2, 3, 4, or 5 more years.

In embodiments, the method includes: (i) isolating DNA from multiple cells of a DCIS cancer cell proliferation of the subject thereby forming a plurality of isolated DCIS cancer cell proliferation DNA molecules, (ii) contacting the plurality of isolated DCIS cancer cell proliferation DNA molecules with a bisulfite salt thereby forming a plurality of reacted DCIS cancer cell proliferation DNA molecules, (iii) detecting the proportion of DNA molecules in the plurality of reacted DCIS cancer cell proliferation DNA molecules having a uracil at a methylation site set forth in Table 1, thereby detecting methylation or unmethylation of said DCIS cancer cell proliferation DNA of the subject.

The methylation of a CpG site of interest may vary between individual cells (and even between chromosome pairs of individual cells) in a biological sample. When DNA is obtained from a biological sample and treated with a bisulfite salt to convert unmethylated cytosines to uracils, the bisulfite-treated DNA will typically contain (i) a proportion of DNA molecules with a cytosine at the site of interest (indicating that the site was methylated); and (ii) a proportion of DNA molecules with a uracil at the site of interest (indicating that the site was unmethylated). Since a uracil at a site of interest in bisulfite-treated DNA indicates that the site was unmethylated in the untreated DNA, a thymidine at the corresponding site in an amplicon of the bisulfite-treated DNA (e.g., an amplicon obtained by PCR) also indicates that the site was unmethylated in the untreated DNA.

In embodiments, the level of methylation at a site of interest is the proportion of bisulfite-treated DNA molecules having a cytosine rather than a uracil at that site of interest. In embodiments, the level of methylation at a site of interest is the proportion of amplicons of bisulfite-treated DNA molecules having a cytosine rather than a thymidine at that site of interest.

In embodiments, the level of unmethylation at a site of interest is the proportion of bisulfite-treated DNA molecules having a uracil rather than a cytosine at that site of interest. In embodiments, the level of unmethylation at a site of interest is the proportion of amplicons of bisulfite-treated DNA molecules having a thymidine rather than a cytosine at that site of interest. In Table 1, an indicated level of uracil is the proportion of bisulfite-treated DNA molecules having a uracil rather than a cytosine at the specified methylation site. The same levels listed in Table 1 also apply to the thymidine levels at a site of interest in an amplicon, i.e., the proportion of amplicons (derived from the PCR amplification of bisulfite-treated DNA molecules) having a thymidine rather than a cytosine at the specified methylation site.

The level of DNA methylation at a site of interest (e.g., a methylation site listed in Table 1) may be determined using sequencing technology. Sequencing technology can reveal nucleotide sequence variations in a plurality of DNA molecules at a single nucleotide base resolution. For example, the proportions of corresponding DNA molecules having a uracil, a thymidine, and/or a cytosine at a site may be determined. A non-limiting example of a sequencing-based method for determining the methylation level at a site of interest is described in Masser et al. (2015) Targeted DNA Methylation Analysis by Next-generation Sequencing, J Vis Exp. (96): 52488, the entire content of which is incorporated herein by reference.

The chromosomal positions listed in Tables 1-3 relate to the human genome that is publically accessible in the University of California Santa Cruz (UCSC) genome browser database under accession number HG19, the entire content of which is incorporated herein by reference in its entirety. Non-limiting information regarding the UCSC Genome Browser is provided in Kent W J, Sugnet C W, Furey T S, Roskin K M, Pringle T H, Zahler A M, Haussler D. The human genome browser at UCSC. Genome Res. 2002 June; 12(6):996-1006, the entire content of which is incorporated herein by reference. Each methylation site of interest listed in Table 1 may be located in other human genomes (e.g., within the genome of a specific subject or group of subjects) by replacing every U and R in the corresponding sequence with a C and then searching for the location of the X within a reference genome by aligning the sequence against the reference genome. For example, the methylation site of interest "X" in SEQ ID NO:1 may be located within a genome by replacing each U and R in SEQ ID NO: 1 with a C (to obtain the pre-bisulfate-modified sequence having an X at the site of interest) and then aligning the sequence against the genome using a BLAST algorithm. Also expressly provided, disclosed, and incorporated herein is the non-bisulfite-modified sequence corresponding to each of SEQ ID NOS: 1-242. The non-bisulfate-modified sequence corresponding to each of SEQ ID NOS: 1-242 is each respective sequence in which each U and R is replaced with a C, where X is the methylation site of interest. For example, the non-bisulfite-modified sequence corresponding to SEQ ID NO:1 provided herein is a modified version of SEQ ID NO:1 in which each U and R in SEQ ID NO:1 is replaced with a C, where X is the methylation site of interest; the non-bisulfate-modified sequence corresponding to SEQ ID NO:2 provided herein is a modified version of SEQ ID NO:2 in which each U and R in SEQ ID NO:2 is replaced with a C, where X is the methylation site of interest; the non-bisulfite-modified sequence corresponding to SEQ ID NO:3 provided herein is a modified version of SEQ ID NO:3 in which each U and R in SEQ ID NO:3 is replaced with a C, where X is the methylation site of interest, and so on.

The chromosome positions listed herein correspond to the cytosine (of the CpG methylation site) that is methylated on the forward strand. However, the cytosine of the reverse complement of the forward strand's CpG methylation site may also or alternatively be methylated. At each chromosomal position provided, methylation may be determined for the forward strand, the reverse strand, or both the forward strand and the reverse strand. In embodiments, each chromosomal position listed herein may refer to (i) the cytosine of the methylation site on the forward strand, (ii) the corresponding cytosine on the reverse strand of the methylation site, or (iii) both the cytosine of the methylation site on the forward strand and the corresponding cytosine on the reverse strand of the methylation site.

TABLE 1

| Site | Chromosome | Chromosomal position | Uracil level in invasive-competent DCIS is about above indicated level* | Uracil level in invasive-competent DCIS is about below indicated level* | SEQ ID NO: Forward Strand | SEQ ID NO: Reverse Strand |
|---|---|---|---|---|---|---|
| 1 | chr1 | 4714314 | N/A | 74.32 | 1 | 2 |
| 2 | chr1 | 11413742 | 76.09 | N/A | 3 | 4 |
| 3 | chr1 | 39957798 | N/A | 63.81 | 5 | 6 |
| 4 | chr1 | 46951513 | N/A | 85.11 | 7 | 8 |
| 5 | chr1 | 47904912 | N/A | 73.08 | 9 | 10 |
| 6 | chr1 | 62660691 | N/A | 71.20 | 11 | 12 |
| 7 | chr1 | 63785800 | N/A | 46.94 | 13 | 14 |
| 8 | chr1 | 67600465 | N/A | 42.86 | 15 | 16 |
| 9 | chr1 | 91183172 | N/A | 48.28 | 17 | 18 |
| 10 | chr1 | 166853786 | N/A | 64.29 | 19 | 20 |
| 11 | chr1 | 179545096 | N/A | 88.89 | 21 | 22 |
| 12 | chr1 | 207669851 | N/A | 89.29 | 23 | 24 |
| 13 | chr1 | 237205704 | N/A | 82.61 | 25 | 26 |
| 14 | chr1 | 237205705 | N/A | 78.57 | 25 | 26 |
| 15 | chr1 | 240161215 | N/A | 60.00 | 27 | 28 |
| 16 | chr1 | 240934954 | 78.57 | N/A | 29 | 30 |
| 17 | chr10 | 8076277 | N/A | 75.00 | 31 | 32 |
| 18 | chr10 | 50818610 | N/A | 76.30 | 33 | 34 |
| 19 | chr10 | 77157527 | N/A | 50.43 | 35 | 36 |
| 20 | chr10 | 123778639 | 74.49 | N/A | 37 | 38 |
| 21 | chr10 | 123778640 | 79.31 | N/A | 37 | 38 |
| 22 | chr10 | 124902829 | N/A | 67.35 | 39 | 40 |
| 23 | chr10 | 124909545 | N/A | 80.00 | 41 | 42 |
| 24 | chr10 | 130085373 | N/A | 76.74 | 43 | 44 |
| 25 | chr10 | 134598235 | N/A | 34.43 | 45 | 46 |
| 26 | chr10 | 134599080 | N/A | 79.31 | 47 | 48 |
| 27 | chr11 | 1215978 | 74.47 | N/A | 49 | 50 |
| 28 | chr11 | 9025912 | N/A | 65.85 | 51 | 52 |
| 29 | chr11 | 15963013 | N/A | 51.72 | 53 | 54 |
| 30 | chr11 | 66187593 | N/A | 80.95 | 55 | 56 |
| 31 | chr11 | 71318977 | N/A | 51.52 | 57 | 58 |
| 32 | chr11 | 101453451 | N/A | 57.89 | 59 | 60 |
| 33 | chr12 | 49726711 | N/A | 60.00 | 61 | 62 |
| 34 | chr12 | 50297756 | N/A | 69.81 | 63 | 64 |
| 35 | chr12 | 50297763 | N/A | 82.98 | 63 | 64 |
| 36 | chr12 | 50297768 | N/A | 81.13 | 63 | 64 |
| 37 | chr12 | 50297774 | N/A | 75.47 | 63 | 64 |
| 38 | chr12 | 50297776 | N/A | 77.36 | 63 | 64 |
| 39 | chr12 | 50444766 | N/A | 54.17 | 65 | 66 |
| 40 | chr12 | 75601447 | N/A | 52.00 | 67 | 68 |
| 41 | chr12 | 95941925 | N/A | 36.84 | 69 | 70 |
| 42 | chr12 | 128750309 | 83.33 | N/A | 71 | 72 |
| 43 | chr12 | 129338355 | N/A | 57.14 | 73 | 74 |
| 44 | chr12 | 129338471 | N/A | 60.71 | 75 | 76 |
| 45 | chr13 | 28502190 | N/A | 65.85 | 77 | 78 |
| 46 | chr13 | 79181509 | N/A | 79.84 | 79 | 80 |
| 47 | chr13 | 92051154 | N/A | 70.70 | 81 | 82 |
| 48 | chr13 | 95363553 | N/A | 73.91 | 83 | 84 |
| 49 | chr13 | 95363592 | N/A | 78.95 | 83 | 84 |
| 50 | chr14 | 29236052 | N/A | 72.36 | 85 | 86 |
| 51 | chr14 | 29236065 | N/A | 62.60 | 85 | 86 |
| 52 | chr14 | 101543886 | N/A | 92.45 | 87 | 88 |
| 53 | chr15 | 29407958 | N/A | 69.84 | 89 | 90 |
| 54 | chr15 | 45403826 | N/A | 73.68 | 91 | 92 |
| 55 | chr15 | 76630094 | N/A | 62.30 | 93 | 94 |
| 56 | chr15 | 89951787 | N/A | 39.68 | 95 | 96 |
| 57 | chr16 | 1255253 | 84.62 | N/A | 97 | 98 |
| 58 | chr17 | 3211643 | 82.35 | N/A | 99 | 100 |
| 59 | chr17 | 30244229 | 70.45 | N/A | 101 | 102 |
| 60 | chr17 | 35294171 | N/A | 71.43 | 103 | 104 |
| 61 | chr17 | 64831307 | N/A | 56.52 | 105 | 106 |
| 62 | chr17 | 74136562 | N/A | 43.48 | 107 | 108 |

TABLE 1-continued

| Site | Chromosome | Chromosomal position | Uracil level in invasive-competent DCIS is about above indicated level* | Uracil level in invasive-competent DCIS is about below indicated level* | SEQ ID NO: Forward Strand | SEQ ID NO: Reverse Strand |
|---|---|---|---|---|---|---|
| 63 | chr17 | 74865566 | N/A | 62.79 | 109 | 110 |
| 64 | chr18 | 19745047 | N/A | 67.01 | 111 | 112 |
| 65 | chr18 | 19745054 | N/A | 64.10 | 111 | 112 |
| 66 | chr18 | 19747206 | N/A | 80.00 | 113 | 114 |
| 67 | chr18 | 44774403 | N/A | 68.29 | 115 | 116 |
| 68 | chr18 | 55103840 | N/A | 66.20 | 117 | 118 |
| 69 | chr18 | 55106910 | N/A | 50.00 | 119 | 120 |
| 70 | chr18 | 70534832 | N/A | 66.67 | 121 | 122 |
| 71 | chr18 | 72880039 | 56.52 | N/A | 123 | 124 |
| 72 | chr18 | 77547934 | N/A | 33.33 | 125 | 126 |
| 73 | chr19 | 30016170 | N/A | 38.89 | 127 | 128 |
| 74 | chr19 | 30017283 | N/A | 60.00 | 129 | 130 |
| 75 | chr19 | 30717013 | N/A | 54.24 | 131 | 132 |
| 76 | chr19 | 30719659 | N/A | 66.67 | 133 | 134 |
| 77 | chr2 | 20870821 | N/A | 12.20 | 135 | 136 |
| 78 | chr2 | 45156764 | N/A | 34.25 | 137 | 138 |
| 79 | chr2 | 74743346 | N/A | 34.69 | 139 | 140 |
| 80 | chr2 | 80549703 | N/A | 28.21 | 141 | 142 |
| 81 | chr2 | 95989474 | 84.21 | N/A | 143 | 144 |
| 82 | chr2 | 105471544 | N/A | 63.64 | 145 | 146 |
| 83 | chr2 | 115919663 | N/A | 64.44 | 147 | 148 |
| 84 | chr2 | 115920004 | N/A | 79.31 | 149 | 150 |
| 85 | chr2 | 118982006 | N/A | 47.06 | 151 | 152 |
| 86 | chr2 | 177001540 | N/A | 63.16 | 153 | 154 |
| 87 | chr20 | 1294019 | N/A | 55.43 | 155 | 156 |
| 88 | chr20 | 3073503 | N/A | 62.96 | 157 | 158 |
| 89 | chr20 | 10198305 | N/A | 62.44 | 159 | 160 |
| 90 | chr20 | 23015989 | N/A | 80.70 | 161 | 162 |
| 91 | chr20 | 23016002 | N/A | 65.59 | 161 | 162 |
| 92 | chr20 | 26189258 | N/A | 55.56 | 163 | 164 |
| 93 | chr20 | 48626669 | N/A | 36.00 | 165 | 166 |
| 94 | chr20 | 53092916 | N/A | 72.13 | 167 | 168 |
| 95 | chr20 | 59827619 | N/A | 58.82 | 169 | 170 |
| 96 | chr20 | 59828325 | N/A | 76.47 | 171 | 172 |
| 97 | chr21 | 9825842 | N/A | 37.32 | 173 | 174 |
| 98 | chr21 | 9826150 | N/A | 50.00 | 175 | 176 |
| 99 | chr21 | 9826934 | N/A | 53.36 | 177 | 178 |
| 100 | chr22 | 43807517 | N/A | 40.68 | 179 | 180 |
| 101 | chr3 | 14852857 | N/A | 57.54 | 181 | 182 |
| 102 | chr3 | 121903470 | N/A | 71.96 | 183 | 184 |
| 103 | chr3 | 170303393 | N/A | 68.63 | 185 | 186 |
| 104 | chr3 | 170303422 | N/A | 67.65 | 185 | 186 |
| 105 | chr3 | 170303423 | N/A | 81.82 | 185 | 186 |
| 106 | chr3 | 170303424 | N/A | 56.52 | 185 | 186 |
| 107 | chr3 | 170303425 | N/A | 69.77 | 185 | 186 |
| 108 | chr4 | 44449864 | N/A | 78.38 | 187 | 188 |
| 109 | chr4 | 54976099 | N/A | 72.00 | 189 | 190 |
| 110 | chr4 | 56023880 | N/A | 55.10 | 191 | 192 |
| 111 | chr5 | 71014951 | N/A | 65.00 | 193 | 194 |
| 112 | chr5 | 72677229 | N/A | 80.82 | 195 | 196 |
| 113 | chr5 | 87981177 | N/A | 55.26 | 197 | 198 |
| 114 | chr5 | 140743998 | N/A | 71.83 | 199 | 200 |
| 115 | chr5 | 178421786 | N/A | 56.25 | 201 | 202 |
| 116 | chr6 | 41337153 | N/A | 57.25 | 203 | 204 |
| 117 | chr6 | 85484102 | N/A | 68.18 | 205 | 206 |
| 118 | chr6 | 157557787 | N/A | 55.56 | 207 | 208 |
| 119 | chr6 | 160769248 | N/A | 75.51 | 209 | 210 |
| 120 | chr7 | 1282082 | N/A | 70.45 | 211 | 212 |
| 121 | chr7 | 32467637 | N/A | 31.03 | 213 | 214 |
| 122 | chr7 | 71801896 | N/A | 63.89 | 215 | 216 |
| 123 | chr7 | 71801905 | N/A | 63.89 | 215 | 216 |
| 124 | chr7 | 100946148 | N/A | 55.17 | 217 | 218 |
| 125 | chr7 | 100946151 | N/A | 43.66 | 217 | 218 |
| 126 | chr7 | 121957003 | N/A | 75.00 | 219 | 220 |
| 127 | chr7 | 150038502 | N/A | 84.83 | 221 | 222 |
| 128 | chr7 | 157477232 | N/A | 26.45 | 223 | 224 |
| 129 | chr7 | 157477399 | N/A | 71.43 | 225 | 226 |
| 130 | chr7 | 157477401 | N/A | 92.59 | 225 | 226 |
| 131 | chr8 | 9764011 | N/A | 70.91 | 227 | 228 |
| 132 | chr8 | 11566080 | N/A | 85.51 | 229 | 230 |
| 133 | chr8 | 11566102 | N/A | 65.22 | 229 | 230 |
| 134 | chr8 | 11566125 | N/A | 65.22 | 229 | 230 |

TABLE 1-continued

| Site | Chromosome | Chromosomal position | Uracil level in invasive-competent DCIS is about above indicated level* | Uracil level in invasive-competent DCIS is about below indicated level* | SEQ ID NO: Forward Strand | SEQ ID NO: Reverse Strand |
|---|---|---|---|---|---|---|
| 135 | chr8 | 56015232 | N/A | 53.85 | 231 | 232 |
| 136 | chr8 | 65281933 | N/A | 95.00 | 233 | 234 |
| 137 | chr8 | 145105472 | N/A | 44.93 | 235 | 236 |
| 138 | chr9 | 126780185 | N/A | 85.19 | 237 | 238 |
| 139 | chr9 | 127239956 | N/A | 66.96 | 239 | 240 |
| 140 | chr9 | 140772369 | N/A | 84.62 | 241 | 242 |

* Level values provided are the proportion (percentage) of reacted DCIS cancer cell proliferation DNA molecules having a uracil at the methylation site of interest.
When amplicons generated from reacted DCIS cancer cell proliferation DNA molecules (e.g., by PCR) are used to assess the level of methylation, the values provided correspond to the proportion of amplicons having a thymidine at the nucleotide position that corresponds to the methylation site of interest.

In embodiments, the method of detecting methylation or unmethylation of a DCIS cancer cell proliferation DNA of a subject detects an alteration in methylation including increase or loss of uracil level at one methylation site or a plurality of methylation sites. In embodiments, the method of detecting methylation or unmethylation of a DCIS cancer cell proliferation DNA of a subject detects an alteration in methylation including increase or loss of thymidine level at plurality of methylation sites. In embodiments, the indicated levels in Tables 1, 2, and 3 are approximate indicated levels, and include values that are within about 15%, about 10%, or about 5% above and below the indicated levels.

In embodiments, the uracil level is above a threshold as set forth in Table 2 in subjects with invasive competent DCIS cancer cell proliferations. In embodiments, the thymidine level is above a threshold as set forth in Table 2 in subjects with invasive competent DCIS cancer cell proliferations. In embodiments, the uracil level is below a threshold as set forth in Table 2 in subjects with invasive incompetent DCIS cancer cell proliferations. In embodiments, the thymidine level is below a threshold as set forth in Table 2 in subjects with invasive incompetent DCIS cancer cell proliferations. In embodiments, subject with invasive competent DCIS are identified as at risk of IDC. In embodiments, subject with invasive incompetent DCIS are identified as not at risk of IDC.

TABLE 2

Methylation threshold for invasive competent DCIS

| Chromosome | Chromosomal position | Uracil level in invasive competent DCIS is about above indicated level* |
|---|---|---|
| chr1 | 11413742 | 76.09 |
| chr1 | 240934954 | 78.57 |
| chr10 | 123778639 | 74.49 |
| chr10 | 123778640 | 79.31 |
| chr11 | 1215978 | 74.47 |
| chr12 | 128750309 | 83.33 |

*Level values provided are the proportion (percentage) of reacted DCIS cancer cell proliferation DNA molecules having a uracil at the methylation site of interest. When amplicons generated from reacted DCIS cancer cell proliferation DNA molecules (e.g., by PCR) are used to assess the level of methylation, the values provided correspond to the proportion of amplicons having a thymidine at the nucleotide position that corresponds to the methylation site of interest.

In embodiments, the uracil level is above a threshold as set forth in Table 3 in subjects with invasive incompetent DCIS cancer cell proliferations. In embodiments, the thymidine level is above a threshold as set forth in Table 3 in subjects with invasive incompetent DCIS cancer cell proliferations. In embodiments, the uracil level is below a threshold as set forth in Table 3 in subjects with invasive competent DCIS cancer cell proliferations. In embodiments, the thymidine level is below a threshold as set forth in Table 3 in subjects with invasive competent DCIS cancer cell proliferations.

TABLE 3

Methylation threshold for invasive-incompetent DCIS

| Chromosome | Chromosomal position | Uracil level in invasive-competent DCIS is about below indicated level* |
|---|---|---|
| chr1 | 4714314 | 74.32 |
| chr1 | 39957798 | 63.81 |
| chr1 | 46951513 | 85.11 |
| chr1 | 47904912 | 73.08 |
| chr1 | 62660691 | 71.20 |
| chr1 | 63785800 | 46.94 |
| chr1 | 67600465 | 42.86 |
| chr1 | 91183172 | 48.28 |
| chr1 | 166853786 | 64.29 |
| chr1 | 179545096 | 88.89 |
| chr1 | 207669851 | 89.29 |
| chr1 | 237205704 | 82.61 |
| chr1 | 237205705 | 78.57 |
| chr1 | 240161215 | 60.00 |
| chr10 | 8076277 | 75.00 |
| chr10 | 50818610 | 76.30 |
| chr10 | 77157527 | 50.43 |
| chr10 | 124902829 | 67.35 |
| chr10 | 124909545 | 80.00 |
| chr10 | 130085373 | 76.74 |
| chr10 | 134598235 | 34.43 |
| chr10 | 134599080 | 79.31 |
| chr11 | 9025912 | 65.85 |
| chr11 | 15963013 | 51.72 |
| chr11 | 66187593 | 80.95 |
| chr11 | 71318977 | 51.52 |
| chr11 | 101453451 | 57.89 |
| chr12 | 49726711 | 60.00 |
| chr12 | 50297756 | 69.81 |
| chr12 | 50297763 | 82.98 |
| chr12 | 50297768 | 81.13 |
| chr12 | 50297774 | 75.47 |
| chr12 | 50297776 | 77.36 |
| chr12 | 50444766 | 54.17 |
| chr12 | 75601447 | 52.00 |
| chr12 | 95941925 | 36.84 |
| chr12 | 129338355 | 57.14 |

TABLE 3-continued

Methylation threshold for invasive-incompetent DCIS

| Chromosome | Chromosomal position | Uracil level in invasive-competent DCIS is about below indicated level* |
|---|---|---|
| chr12 | 129338471 | 60.71 |
| chr13 | 28502190 | 65.85 |
| chr13 | 79181509 | 79.84 |
| chr13 | 92051154 | 70.70 |
| chr13 | 95363553 | 73.91 |
| chr13 | 95363592 | 78.95 |
| chr14 | 29236052 | 72.36 |
| chr14 | 29236065 | 62.60 |
| chr14 | 101543886 | 92.45 |
| chr15 | 29407958 | 69.84 |
| chr15 | 45403826 | 73.68 |
| chr15 | 76630094 | 62.30 |
| chr15 | 89951787 | 39.68 |
| chr17 | 35294171 | 71.43 |
| chr17 | 64831307 | 56.52 |
| chr17 | 74136562 | 43.48 |
| chr17 | 74865566 | 62.79 |
| chr18 | 19745047 | 67.01 |
| chr18 | 19745054 | 64.10 |
| chr18 | 19747206 | 80.00 |
| chr18 | 44774403 | 68.29 |
| chr18 | 55103840 | 66.20 |
| chr18 | 55106910 | 50.00 |
| chr18 | 70534832 | 66.67 |
| chr18 | 77547934 | 33.33 |
| chr19 | 30016170 | 38.89 |
| chr19 | 30017283 | 60.00 |
| chr19 | 30717013 | 54.24 |
| chr19 | 30719659 | 66.67 |
| chr2 | 20870821 | 12.20 |
| chr2 | 45156764 | 34.25 |
| chr2 | 74743346 | 34.69 |
| chr2 | 80549703 | 28.21 |
| chr2 | 105471544 | 63.64 |
| chr2 | 115919663 | 64.44 |
| chr2 | 115920004 | 79.31 |
| chr2 | 118982006 | 47.06 |
| chr2 | 177001540 | 63.16 |
| chr20 | 1294019 | 55.43 |
| chr20 | 3073503 | 62.96 |
| chr20 | 10198305 | 62.44 |
| chr20 | 23015989 | 80.70 |
| chr20 | 23016002 | 65.59 |
| chr20 | 26189258 | 55.56 |
| chr20 | 48626669 | 36.00 |
| chr20 | 53092916 | 72.13 |
| chr20 | 59827619 | 58.82 |
| chr20 | 59828325 | 76.47 |
| chr21 | 9825842 | 37.32 |
| chr21 | 9826150 | 50.00 |
| chr21 | 9826934 | 53.36 |
| chr22 | 43807517 | 40.68 |
| chr3 | 14852857 | 57.54 |
| chr3 | 121903470 | 71.96 |
| chr3 | 170303393 | 68.63 |
| chr3 | 170303422 | 67.65 |
| chr3 | 170303423 | 81.82 |
| chr3 | 170303424 | 56.52 |
| chr3 | 170303425 | 69.77 |
| chr4 | 44449864 | 78.38 |
| chr4 | 54976099 | 72.00 |
| chr4 | 56023880 | 55.10 |
| chr5 | 71014951 | 65.00 |
| chr5 | 72677229 | 80.82 |
| chr5 | 87981177 | 55.26 |
| chr5 | 140743998 | 71.83 |
| chr5 | 178421786 | 56.25 |
| chr6 | 41337153 | 57.25 |
| chr6 | 85484102 | 68.18 |
| chr6 | 157557787 | 55.56 |
| chr6 | 160769248 | 75.51 |
| chr7 | 1282082 | 70.45 |
| chr7 | 32467637 | 31.03 |
| chr7 | 71801896 | 63.89 |
| chr7 | 71801905 | 63.89 |
| chr7 | 100946148 | 55.17 |
| chr7 | 100946151 | 43.66 |
| chr7 | 121957003 | 75.00 |
| chr7 | 150038502 | 84.83 |
| chr7 | 157477232 | 26.45 |
| chr7 | 157477399 | 71.43 |
| chr7 | 157477401 | 92.59 |
| chr8 | 9764011 | 70.91 |
| chr8 | 11566080 | 85.51 |
| chr8 | 11566102 | 65.22 |
| chr8 | 11566125 | 65.22 |
| chr8 | 56015232 | 53.85 |
| chr8 | 65281933 | 95.00 |
| chr8 | 145105472 | 44.93 |
| chr9 | 126780185 | 85.19 |
| chr9 | 127239956 | 66.96 |
| chr9 | 140772369 | 84.62 |

*Level values provided are the proportion (percentage) of reacted DCIS cancer cell proliferation DNA molecules having a uracil at the methylation site of interest. When amplicons generated from reacted DCIS cancer cell proliferation DNA molecules (e.g., by PCR) are used to assess the level of methylation, the values provided correspond to the proportion of amplicons having a thymidine at the nucleotide position that corresponds to the methylation site of interest.

In embodiments, the method of detecting methylation or unmethylation of a DCIS cancer cell proliferation DNA is of a candidate breast cancer patient. In embodiments, the subject is suspected of having IDC, invasive competent DCIS, invasive incompetent DCIS, or DCIS. In embodiments, the subject has IDC, invasive competent DCIS, invasive incompetent DCIS, or DCIS.

In embodiments, the method of detecting methylation or unmethylation of a DCIS cancer cell proliferation DNA is based on the level of uracil as set forth Table 2, in which the uracil level above the threshold identifies the DCIS cancer cell proliferation as invasive competent. In embodiments, the method of detecting methylation or unmethylation of a DCIS cancer cell proliferation DNA is based on a level of thymidine indicated in Table 2, in which the thymidine level above the threshold identifies the DCIS cancer cell proliferation as invasive competent. In embodiments, the level is the proportion of molecules (e.g., in a plurality of reacted DCIS cancer cell proliferation DNA molecules or a plurality of reacted DCIS cancer cell proliferation DNA amplicons) having a uracil or thymidine as determined by a quantitation method. Non-limiting examples of quantitation methods include sequencing and microarray methods.

In embodiments, the method of detecting methylation or unmethylation of a DCIS cancer cell proliferation DNA is based on the level of uracil as set forth Table 3, in which the uracil level above the threshold identifies the DCIS cancer cell proliferation as invasive incompetent. In embodiments, the method of detecting methylation or unmethylation of a DCIS cancer cell proliferation DNA is based on a level of thymidine indicated in Table 3, in which the thymidine level above the threshold identifies the DCIS cancer cell proliferation as invasive incompetent. In embodiments, the level is the proportion of molecules (e.g., in a plurality of reacted DCIS cancer cell proliferation DNA molecules or a plurality of reacted DCIS cancer cell proliferation DNA amplicons) having a uracil or thymidine as determined by a quantitation method.

In embodiments, the DCIS cancer cell proliferation is a specimen obtained by laser capture procedure from a biopsy or from surgical resection of a subject.

In embodiments, the subject has undergone lumpectomy or mastectomy, radiation therapy, chemotherapy, and administration of an active agent before the subject undergoes the method of detecting methylation or unmethylation of a breast cancer DNA of the present disclosure.

In embodiments, the method of the present disclosure includes a determination of prognosis for invasive ductal carcinoma.

In embodiments, the method of detecting DNA methylation level in DNA of breast lump may lead to changes in therapeutic regimen for treating the subject. In embodiments, a subject identified as having invasive competent DCIS with a method of the present disclosure may be treated with lumpectomy, mastectomy, radiation therapy, chemotherapy, hormonal therapy (such as but not limited to tamoxifen), or targeted therapy (such as but not limited to trastuzumab and everolimus), or a combination thereof. In embodiments, a subject identified as having invasive incompetent DCIS with a method of the present disclosure is not treated with lumpectomy, mastectomy, radiation therapy, chemotherapy, hormonal therapy, targeted therapy, or a combination thereof.

In embodiments, the active agent administered to a subject before or after detecting the level of methylation or unmethylation is: trastuzumab (e.g., Herceptin®), trastuzumab emtansine (e.g., Kadcyla®), lapatinib (e.g., Tykerb®), pertuzumab (e.g., Perjeta®), bevacizumab (e.g., Avastin®), tamoxifen (e.g., Nolvadex®), exemestane (e.g., Aromasin®), anastrozole (e.g., Arimidex), letrozole (e.g., Femara®), doxorubicin (e.g., Adriamycin®), epirubicin (e.g., Ellence®), cyclophosphamide (e.g., Cytoxan®), docetaxel (e.g., Taxotere®), paclitaxel (e.g., Taxol®), nab paclitaxel (e.g., Abraxane®), eribulin (e.g., Halaven®), everolimus (e.g., Afinitor®), palbociclib (e.g., Ibrance®), capecitabine (e.g., Xeloda®), ixabepilone (e.g., Ixempra®), methotrexate (e.g., Trexall®), or fluorouracil (also called 5-fluorouracil or 5-FU; e.g., Adrucil®).

Method of Determining Breast Cancer or Risk of Developing Invasive Ductal Carcinoma In Situ Aspects further provide a method of detecting a risk of developing IDC in a subject who has DCIS. In embodiments, the method comprises
  (i) contacting an isolated DCIS cancer cell proliferation DNA molecule from the subject with a bisulfate salt thereby forming a reacted DCIS cancer cell proliferation DNA molecule; and
  (ii) detecting the presence or absence of uracil in the reacted DCIS cancer cell proliferation DNA molecule at a methylation site set forth in Table 1, thereby detecting the risk for developing IDC in the subject.

In an aspect, provided herein is a method of diagnosing IDC or detecting risk of IDC in a subject. The method involves:
  (i) isolating a DCIS cancer cell proliferation DNA molecule from a DCIS cancer cell proliferation of the subject thereby forming an isolated DCIS cancer cell proliferation DNA molecule;
  (ii) contacting the isolated DCIS cancer cell proliferation DNA molecule with a bisulfite salt (such as sodium bisulfite) thereby forming a reacted DCIS cancer cell proliferation DNA molecule; and
  (iii) detecting the presence or absence of uracil in the reacted DCIS cancer cell proliferation DNA molecule at a methylation site set forth in Table 1; thereby diagnosing IDC or detecting risk of IDC in the subject.

In an aspect, provided herein is a method of diagnosing IDC or detecting risk of IDC in a subject in need thereof, comprising (i) isolating a plurality of DCIS cancer cell proliferation DNA molecules from the DCIS cancer cell proliferation of the subject thereby forming a plurality of isolated DCIS cancer cell proliferation DNA molecules, (ii) contacting the plurality of isolated DCIS cancer cell proliferation DNA molecules with the bisulfite salt thereby forming a plurality of reacted DCIS cancer cell proliferation DNA molecules, (iii) detecting the level of reacted DCIS cancer cell proliferation DNA molecules in the plurality of reacted DCIS cancer cell proliferation DNA molecules having a uracil at a methylation site set forth in Table 1; thereby diagnosing IDC or detecting risk of IDC in the subject.

In an aspect, provided herein is a method of diagnosing IDC or detecting risk of IDC in a subject in need thereof, comprising (i) contacting a plurality of isolated DCIS cancer cell proliferation DNA molecules from the subject with a bisulfite salt thereby forming a plurality of reacted DCIS cancer cell proliferation DNA molecules; and (ii) detecting the level of reacted DCIS cancer cell proliferation DNA molecules in the plurality of reacted DCIS cancer cell proliferation DNA molecules having a uracil at a plurality of methylation sites set forth in Table 1, thereby detecting the risk for IDC in the subject.

In an aspect, provided herein is a method of diagnosing IDC or detecting risk of IDC in a subject in need thereof, comprising (i) isolating a plurality of DCIS cancer cell proliferation DNA molecules from the DCIS cancer cell proliferation of the subject thereby forming a plurality of isolated DCIS cancer cell proliferation DNA molecules, (ii) contacting the plurality of isolated DCIS cancer cell proliferation DNA molecules with the bisulfite salt thereby forming a plurality of reacted DCIS cancer cell proliferation DNA molecules, (iii) detecting the presence or absence of uracil in a reacted DCIS cancer cell proliferation DNA molecule at a methylation site set forth in Table 1, thereby detecting methylation or unmethylation of the plurality DCIS cancer cell proliferation DNA molecules of the subject.

In an aspect, provided herein is a method of diagnosing IDC or detecting risk of IDC in a subject in need thereof. The method includes: (i) contacting an isolated DCIS cancer cell proliferation DNA molecule from said subject with a bisulfite salt (such as sodium bisulfite) thereby forming a reacted DCIS cancer cell proliferation DNA molecule, (ii) amplifying the reacted DCIS cancer cell proliferation DNA molecule thereby forming a reacted DCIS cancer cell proliferation DNA amplicon molecule, (iii) detecting the presence or absence of thymidine in a reacted DCIS cancer cell proliferation DNA amplicon molecule at a methylation site set forth in Table 1, thereby detecting methylation or unmethylation of the DCIS cancer cell proliferation DNA molecule of the subject. In embodiments, contacting the isolated DCIS cancer cell proliferation DNA with a bisulfite salt comprises adding a solution comprising the bisulfite salt to a solution comprising the isolated single stranded DNA.

In an aspect, provided herein is a method of diagnosing IDC or detecting risk of IDC in a subject in need thereof. The method includes: (i) isolating a DCIS cancer cell proliferation DNA molecule from a DCIS cancer cell proliferation of the subject thereby forming an isolated DCIS cancer cell proliferation DNA molecule, (ii) contacting the isolated DCIS cancer cell proliferation DNA molecule with a bisulfite salt (such as sodium bisulfite) thereby forming a reacted DCIS cancer cell proliferation DNA molecule, (iii) amplifying the reacted DCIS cancer cell proliferation DNA molecule thereby forming a reacted DCIS cancer cell proliferation DNA amplicon molecule, (iv) detecting the presence or absence of thymidine in a reacted DCIS cancer cell proliferation DNA amplicon molecule at a methylation site set forth in Table 1, thereby detecting methylation or unmethylation of the DCIS cancer cell proliferation DNA molecule of the subject. In embodiments, contacting the isolated DCIS cancer cell proliferation DNA with a bisulfite salt comprises adding a solution comprising the bisulfite salt to a solution comprising the isolated single stranded DNA.

In an aspect, provided herein is a method of diagnosing IDC or detecting risk of IDC in a subject in need thereof, comprising (i) contacting a plurality of isolated DCIS cancer cell proliferation DNA molecules from said subject with a bisulfite salt thereby forming a plurality of reacted DCIS cancer cell proliferation DNA molecules, (iii) amplifying the plurality of reacted DCIS cancer cell proliferation DNA molecules thereby forming a plurality of reacted DCIS cancer cell proliferation DNA amplicon molecules, (iv) detecting one or more DCIS cancer cell proliferation DNA amplicon molecules within the plurality of reacted DCIS cancer cell proliferation DNA amplicon molecules having a thymidine at a methylation site set forth in Table 1, thereby detecting methylation or unmethylation of the plurality of DCIS cancer cell proliferation DNA molecules of the subject.

In an aspect, provided herein is a method of diagnosing IDC or detecting risk of IDC in a subject in need thereof, comprising (i) isolating a plurality of DCIS cancer cell proliferation DNA molecules from the DCIS cancer cell proliferation of the subject thereby forming a plurality of isolated DCIS cancer cell proliferation DNA molecules, (ii) contacting the plurality of isolated DCIS cancer cell proliferation DNA molecules with a bisulfite salt thereby forming a plurality of reacted DCIS cancer cell proliferation DNA molecules, (iii) amplifying the plurality of reacted DCIS cancer cell proliferation DNA molecules thereby forming a plurality of reacted DCIS cancer cell proliferation DNA amplicon molecules, (iv) detecting one or more DCIS cancer cell proliferation DNA amplicon molecules within the plurality of reacted DCIS cancer cell proliferation DNA amplicon molecules having a thymidine at a methylation site set forth in Table 1, thereby detecting methylation or unmethylation of the plurality of DCIS cancer cell proliferation DNA molecules of the subject.

In embodiments, detecting one or more DCIS cancer cell proliferation DNA amplicon molecules comprises detecting the level of one or more one or more DCIS cancer cell proliferation DNA amplicon molecules. In embodiments, detecting one or more DCIS cancer cell proliferation DNA amplicon molecules comprises detecting the level of reacted DCIS cancer cell proliferation DNA amplicon molecules in the plurality of reacted DCIS cancer cell proliferation DNA amplicon molecules having a thymidine at a methylation site set forth in Table 1, thereby detecting the level of methylation or unmethylation in the plurality of DCIS cancer cell proliferation DNA molecules of the subject.

In embodiments, detecting a level includes determining the number (e.g. quantitating) or molecules having, e.g., a thymidine or a uracil. In embodiments, detecting a level includes detecting the portion or proportion of a population or plurality of molecules having, e.g., a thymidine or a uracil.

In embodiments, contacting the isolated DCIS cancer cell proliferation DNA with a bisulfite salt comprises adding a solution comprising the bisulfite salt to a solution comprising the isolated DCIS cancer cell proliferation DNA.

In embodiments, the method of determining diagnosing IDC or detecting risk of IDC in a subject includes selecting a subject that has or is at risk for having or developing diagnosing IDC or detecting risk of IDC. In embodiments, the subject (a) is a woman; (b) is about 30 to about 75 years old; (c) has at least one mutant breast cancer 1 (BRCA1), breast cancer 2 (BRCA2), Partner and localizer of BRCA2 (PALB2), phosphatase and tensin homolog (PTEN), or p53 allele; (d) has a parent, sibling, or child who has been diagnosed with breast cancer; (e) has had the non-cancerous breast diseases atypical ductal hyperplasia or lobular carcinoma in situ; (f) has had previous radiation treatment to the chest or a breast before the age of 30; (g) has received a combination hormone therapy with estrogen and progestin for at least five years; and/or (h) has or has had breast cancer.

In embodiments, the method includes detecting methylation or unmethylation at a plurality of methylation sites set forth in Table 1. In embodiments, the plurality of methylation sites comprises at least about 2, 3, 4, 5, 10, 20, 30, 40, 50, 60, 70, 80, 80, 90, 100, 110, 120, 130, or 140 methylation sites. In embodiments, the plurality of methylation sites comprises less than about 140, 130, 120, 110, 100, 90, 80, 70, 60, 50, 40, 30, 20, or 10 methylation sites. In embodiments, the plurality of methylation sites is about 2, 3, 4, 5, 10, 20, 30, 40, 50, 60, 70, 80, 80, 90, 100, 110, 120, 130, or 140 methylation sites. In embodiments, the plurality of methylation sites includes one, two, or more methylation sites set forth in Table 1 and no other methylation sites.

In embodiments, a method provided herein is practiced for a subject more than once over time. In embodiments, methylation or unmethylation of DCIS cancer cell proliferation DNA from a subject is assessed using a method provided herein at least 1, 2, 3, 4, 5, 6, 7, 8, 9, 10 or more times. In embodiments, the method is repeated at least once every 4, 6, 8, 12 or 18 months, or at least once every 2, 3, 4, or 5 more years.

In embodiments, the method of diagnosing IDC or detecting risk of IDC in a subject in need thereof includes determining alteration in methylation at a plurality of methylation sites set forth in Table 1. In embodiments, the method comprises: (i) isolating DNA from multiple cells of a DCIS cancer cell proliferation of the subject thereby forming a plurality of isolated DCIS cancer cell proliferation DNA molecules, (ii) contacting the plurality of isolated DCIS cancer cell proliferation DNA molecules with a bisulfite salt thereby forming a plurality of reacted DCIS cancer cell proliferation DNA molecules, (iii) detecting the proportion of DNA molecules in the plurality of reacted DCIS cancer cell proliferation DNA molecules having a uracil at a methylation site set forth in Table 1.

In embodiments, the method of diagnosing IDC or detecting risk of IDC in a subject in need thereof includes alteration, i.e., increase or loss of uracil level at plurality of methylation sites. In embodiments, the method of determining a diagnosing IDC or detecting risk of IDC in a subject in need thereof includes alteration, i.e., increase or loss of thymidine level at plurality of methylation sites.

In embodiments, the method of diagnosing IDC or detecting risk of IDC in a subject in need thereof includes determining a uracil level which is above a threshold as set forth in Table 2. In embodiments, the method of diagnosing IDC or detecting risk of IDC in a subject in need thereof includes determining a thymidine level which is above a threshold indicated in Table 2. In embodiments, the level is the proportion of molecules (e.g., in a plurality of reacted DCIS cancer cell proliferation DNA molecules or a plurality of reacted DCIS cancer cell proliferation DNA amplicons) having a uracil or thymidine as determined by a quantitation method.

In embodiments, the method of diagnosing IDC or detecting risk of IDC in a subject in need thereof includes determining a uracil level which is below a threshold as set forth in Table 3. In embodiments, the method of diagnosing IDC or detecting risk of IDC in a subject in need thereof includes determining a thymidine level which is below a threshold indicated in Table 3. In embodiments, the level is the proportion of molecules (e.g., in a plurality of reacted DCIS cancer cell proliferation DNA molecules or a plurality of reacted DCIS cancer cell proliferation DNA amplicons) having a uracil or thymidine as determined by a quantitation method.

In embodiments, the method of diagnosing IDC or detecting risk of IDC involves a candidate IDC patient. In embodiments, the subject is suspected of having IDC or IC-DCIS. In embodiments, the subject has IC-DCIS.

In embodiments, the method of diagnosing IDC or detecting risk of IDC in a subject in need thereof includes determining a uracil level in which a threshold above the threshold set forth in Table 2 identifies the DCIS cancer cell proliferation as IC-DCIS or IDC. In embodiments, the method of diagnosing IDC or detecting risk of IDC in a subject in need thereof includes determining a thymidine level in which a threshold above the threshold indicated in Table 2 identifies the DCIS cancer cell proliferation as a IC-DCIS or IDC. In embodiments, the level is the proportion of molecules (e.g., in a plurality of reacted DCIS cancer cell proliferation DNA molecules or a plurality of reacted DCIS cancer cell proliferation DNA amplicons) having a uracil or thymidine as determined by a quantitation method.

In embodiments, the method of diagnosing IDC or detecting risk of IDC in a subject in need thereof includes determining a uracil level in which a threshold above the threshold set forth in Table 3 identifies the DCIS cancer cell proliferation as II-DCIS. In embodiments, the method of determining a diagnosing IDC or detecting risk of IDC in a subject in need thereof includes determining a thymidine level in which a threshold above the threshold indicated in Table 3 identifies the DCIS cancer cell proliferation as II-DCIS. In embodiments, the level is the proportion of molecules (e.g., in a plurality of reacted DCIS cancer cell proliferation DNA molecules or a plurality of reacted DCIS cancer cell proliferation DNA amplicons) having a uracil or thymidine as determined by a quantitation method.

In embodiments, the method of diagnosing IDC or detecting risk of IDC in a subject in need thereof includes determining a uracil level in DNA of a DCIS cancer cell proliferation specimen obtained by biopsy or by surgical resection of a subject. In embodiments, the method of diagnosing IDC or detecting risk of IDC in a subject in need thereof includes determining a thymidine level in DNA of a DCIS cancer cell proliferation specimen obtained by biopsy or by surgical resection of a subject.

Aspects provide methods of determining a prognosis or selecting a treatment for a subject comprising detecting IDC or a risk of IDC in the subject. In embodiments, the subject has previously undergone treatment for breast cancer. In embodiments, the subject was in remission after the previous treatment for breast cancer. In embodiments, breast cancer tissue has been resected from the subject. In embodiments, breast cancer tissue has been resected from the subject, but the subject is not in remission for breast cancer.

In embodiments, the method of diagnosing IDC or detecting risk of IDC may lead to a prognostic assessment of the subject. In embodiments, the method of diagnosing IDC or detecting risk of IDC may lead to a change or a particular choice or set of choices in the therapeutic regimen for treating the subject. For example, a diagnosis of IDC of risk of IDC may lead to a different treatment regimen (such as surgery, hormone therapy, radiation therapy, chemotherapy, targeted therapy, or a combination thereof) compared to a subject who is not diagnosed with IDC or a risk of IDC (such as monitoring or a treatment other than surgery, hormone therapy, radiation therapy, chemotherapy, or targeted therapy). In embodiments, a method of diagnosing IDC or detecting risk of IDC may lead to a determination of susceptibility (i.e., likelihood to respond) to treatment such as surgery, hormone therapy, radiation therapy, chemotherapy, targeted therapy, or a combination thereof. In embodiments a subject identified as having IDC or IDC risk may be treated with surgery, hormone therapy, radiation therapy, chemotherapy, targeted therapy, or any combination thereof. In embodiments, a subject identified as having IDC or being at risk of developing IDC according to a method disclosed herein is advised and/or directed to receive additional screening and/or treatment for breast cancer.

In embodiments, a subject having IDC or at risk of developing IDS is administered an active agent such as trastuzumab, trastuzumab emtansine, lapatinib, pertuzumab, bevacizumab, tamoxifen, exemestane, anastrozole, letrozole, doxorubicin, epirubicin, cyclophosphamide, docetaxel, paclitaxel, nab paclitaxel, eribulin, everolimus, palbociclib, capecitabine, ixabepilone, methotrexate, or fluorouracil.

In embodiments, the method of determining an invasive ductal carcinoma may lead to changes in therapeutic regimen (e.g., treatment and/or dose) for treating the subject. In embodiments a subject identified as having IDC with a method disclosed herein may be treated with trastuzumab, trastuzumab emtansine, lapatinib, pertuzumab, bevacizumab, tamoxifen, exemestane, anastrozole, letrozole, doxorubicin, epirubicin, cyclophosphamide, docetaxel, paclitaxel, nab paclitaxel, eribulin, everolimus, palbociclib, capecitabine, ixabepilone, methotrexate, or fluorouracil.

In embodiments, the active agent administered to a subject after determining IDC is: trastuzumab, trastuzumab emtansine, lapatinib, pertuzumab, bevacizumab, tamoxifen, exemestane, anastrozole, letrozole, doxorubicin, epirubicin, cyclophosphamide, docetaxel, paclitaxel, nab paclitaxel, eribulin, everolimus, palbociclib, capecitabine, ixabepilone, methotrexate, or fluorouracil.

Method of Treating Breast Cancer

The present disclosure provides a method of treating breast cancer in a subject by administering to the subject an active agent for treating breast cancer (such as IDC or IC-DCIS), in which the subject is identified for treatment by a method disclosed herein.

The present disclosure provides a method of treating breast cancer in a subject by administering to the subject an active agent for treating breast cancer (such as IDC or IC-DCIS), in which the subject is identified for treatment by a method including contacting an isolated breast cellular proliferation DNA with sodium bisulfite thereby forming a reacted breast cellular proliferation DNA; and detecting the presence or absence of uracil in the reacted breast cellular proliferation DNA at a methylation site set forth in Table 1; thereby determining ductal carcinoma invasion in the subject. In embodiments, the DCIS is not present as a mass or a lump. In embodiments, the DCIS is found as a mammographic abnormality, such as a microcalcification in a ductal pattern.

In an aspect, provided herein is a method of treating breast cancer in a subject by administering to the subject an active agent for treating breast cancer (such as IDC or IC-DCIS), in which the subject is identified for treatment by a method including isolating DNA from a breast cellular proliferation of the subject thereby forming isolated breast cellular proliferation DNA; contacting the isolated breast cellular proliferation DNA with sodium bisulfite thereby forming a reacted breast cellular proliferation DNA; and detecting the presence or absence of uracil in the reacted breast cellular proliferation DNA at a methylation site set forth in Table 1; thereby determining ductal carcinoma invasion in the subject.

In embodiments, the method of treating a ductal carcinoma in a subject in need thereof includes determining alteration in methylation at a plurality of methylation sites set forth in Table 1.

In embodiments, the method of treating a ductal carcinoma in a subject in need thereof includes alteration which includes increase or loss of uracil level at plurality of methylation sites.

In an aspect, included herein is a method of treating breast cancer in a subject by administering to the subject an active agent for treating breast cancer, in which the subject is identified for treatment by a method including contacting an isolated DCIS cancer cell proliferation DNA molecule from the subject with a bisulfite salt (such as sodium bisulfite) thereby forming a reacted DCIS cancer cell proliferation DNA molecule; and detecting the presence or absence of uracil in the reacted DCIS cancer cell proliferation DNA molecule at a methylation site set forth in Table 1; thereby detecting the breast cancer in the subject. In embodiments, contacting the isolated DCIS cancer cell proliferation DNA with a bisulfite salt comprises adding a solution comprising the bisulfite salt to a solution comprising the isolated DCIS cancer cell proliferation DNA.

Also provided herein is a method of treating breast cancer in a subject by administering to the subject an active agent for treating breast cancer, in which the subject is identified for treatment by a method including isolating a DCIS cancer cell proliferation DNA molecule from a DCIS cancer cell proliferation of the subject thereby forming an isolated DCIS cancer cell proliferation DNA molecule; contacting the isolated DCIS cancer cell proliferation DNA molecule with a bisulfite salt (such as sodium bisulfite) thereby forming a reacted DCIS cancer cell proliferation DNA molecule; and detecting the presence or absence of uracil in the reacted DCIS cancer cell proliferation DNA molecule at a methylation site set forth in Table 1; thereby detecting the breast cancer in the subject. In embodiments, contacting the isolated DCIS cancer cell proliferation DNA with a bisulfite salt comprises adding a solution comprising the bisulfite salt to a solution comprising the isolated DCIS cancer cell proliferation DNA.

In embodiments, the method includes detecting methylation or unmethylation at a plurality of methylation sites set forth in Table 1. In embodiments, the plurality of methylation sites comprises at least about 2, 3, 4, 5, 10, 20, 30, 40, 50, 60, 70, 80, 80, 90, 100, 110, 120, 130, or 140 methylation sites. In embodiments, the plurality of methylation sites comprises less than about 140, 130, 120, 110, 100, 90, 80, 70, 60, 50, 40, 30, 20, or 10 methylation sites. In embodiments, the plurality of methylation sites is about 2, 3, 4, 5, 10, 20, 30, 40, 50, 60, 70, 80, 80, 90, 100, 110, 120, 130, or 140 methylation sites. In embodiments, the plurality of methylation sites includes two or more methylation sites set forth in Table 1 and no other methylation sites.

In embodiments, a method provided herein is practiced for a subject more than once over time. In embodiments, methylation or unmethylation of DCIS cancer cell proliferation DNA from a subject is assessed using a method provided herein at least 1, 2, 3, 4, 5, 6, 7, 8, 9, 10 or more times. In embodiments, the method is repeated at least once every 4, 6, 8, 12 or 18 months, or at least once every 2, 3, 4, or 5 more years.

In embodiments, the method of treating breast cancer in a subject in need thereof includes determining alteration in methylation at a plurality of methylation sites set forth in Table 1.

In embodiments, the method of treating breast cancer in a subject in need thereof includes alteration which includes increase or loss of uracil level at plurality of methylation sites.

In embodiments, the method of treating breast cancer in a subject in need thereof includes determining a uracil level which is above a threshold as set forth in Table 2. In embodiments, the method of treating breast cancer in a subject in need thereof includes determining a thymidine level which is above a threshold indicated in Table 2. In embodiments, the level is the proportion of molecules (e.g., in a plurality of reacted DCIS cancer cell proliferation DNA molecules or a plurality of reacted DCIS cancer cell proliferation DNA amplicons) having a uracil or thymidine as determined by a quantitation method.

In embodiments, the method of treating breast cancer in a subject in need thereof includes determining a uracil level which is below a threshold as set forth in Table 3. In embodiments, the method of treating breast cancer in a subject in need thereof includes determining a thymidine level which is below a threshold indicated in Table 3. In embodiments, the level is the proportion of molecules (e.g., in a plurality of reacted DCIS cancer cell proliferation DNA molecules or a plurality of reacted DCIS cancer cell proliferation DNA amplicons) having a uracil or thymidine as determined by a quantitation method.

In embodiments, the method of treating breast cancer includes administering surgery, radiation therapy, chemotherapy, targeted therapy, or hormone therapy, before the detection of IDC.

In embodiments, the method of treating breast cancer includes administering an active agent such as trastuzumab, trastuzumab emtansine, lapatinib, pertuzumab, bevacizumab, tamoxifen, exemestane, anastrozole, letrozole, doxorubicin, epirubicin, cyclophosphamide, docetaxel, paclitaxel, nab paclitaxel, eribulin, everolimus, palbociclib, capecitabine, ixabepilone, methotrexate, or fluorouracil, before the detection of IDC.

Target Sites for Methylation Level of Breast Lump

In embodiments, the present disclosure includes a deoxyribonucleic acid 5 to 100 nucleotides in length including a uracil-containing sequence identical to at least a 5 contiguous nucleotide sequence within a sequence including SEQ ID NO:1 to SEQ ID NO: 242.

Included herein are about 300 bp length sequences which are surrounding the target sites (e.g., 149 or 150 bp from each site). The sequences are after bisulfite conversion. Therefore "C" in the non-CpG context becomes "U", and C in the CpG context is designated as R (either "U" either "C"). The DNA strands (sense and antisense) are no longer complementary after bisulfite conversion. Therefore, each DNA strand are identified here with their unique sequence, and designated as "forward" and "reverse", respectively.

In embodiments, the present disclosure includes a DNA molecule which includes a methylation site set forth in Table 1.

Also provided herein is a DNA molecule comprising a nucleotide sequence that is identical to 5-10, 10-20, 20-30, 30-40, 40-50, 50-60, 60-70, 70-80, 80-90, 90-100, 100-110, 110-120, 120-130, 130-140, 140-150, 150-160, 160-170, 170-180, 180-190, or 190-200 of contiguous nucleotide sequence of the sequence including a sequence of SEQ ID NO:1 to SEQ ID NO: 242. Also included is a plurality of such DNA molecules.

In embodiments, included herein is a plurality of DNA molecules comprising methylation sites set forth in Table 1 are methylated or unmethylated. A plurality of bisulfite-converted DNA molecules comprising methylation sites set forth in Table 1 are also included. In embodiments, the plurality of methylation sites comprises at least about 2, 3, 4, 5, 10, 20, 30, 40, 50, 60, 70, 80, 80, 90, 100, 110, 120, 130, or 140 methylation sites. In embodiments, the plurality of methylation sites comprises between 1-50, 50-100, 100-250, 100-300, 100-400, 100-500, 100-550, 250-550, or 350-500 methylation sites (e.g., methylation sites included herein and others). In embodiments, the plurality of methylation sites does not comprise a methylation site other than the sites listed in Table 1.

SEQ ID NO:1 to SEQ ID NO:242 are sequences that include the target sites (i.e., methylation sites of interest). The sequences provided are as modified after bisulfite conversion. Therefore "C" in the non-CpG context becomes "U", and C in the CpG context is designated as R or X (either "U" either "C"), where X is the target site. The DNA strands (sense and antisense) are no longer complementary after bisulfite conversion. Therefore, each DNA strand is identified with its unique sequence, and is designated as "forward" and "reverse" respectively, in Table 1.

The sequences listed in Table 1 are provided below with their respective sequence identification number.

TABLE 4

Sequences Listed in Table 1

| SEQ ID NO: | Sequence |
|---|---|
| 1 | GGUURGRGTGGUTUAGUTURGUUUUAGGAAAUTTTTRGRGUAGUUUURGUTUUATGRG UUUUUAUUUAGTUUTTUTTRGGGGURGUUUUUTUUUUAAAGTAGUTUTURGGGTUUAU TGGGRGUUUURGTAAURGGGTRGGAAUUTRGAAXGGUTTRGRGTGUUATURGGTTAUU UTGGUAAUAUUATURGGRGGRGUURGGRGGTUUAATUUTAGUUTGRGGUUTUTUTRGA GUUTTTRGUAAGGTGGGGAURGGGARGRGAURGGGGATGGGGAAGGGGGUTGUAGGAG GUUURGUUTG |
| 2 | UAGGRGGGGUUTUUTGUAGUUUUUTTUUUUAUUUURGGTRGRGTUURGGTUUUUAUUT TGRGAAAGGUTRGAGAGAGGURGUAGGUTAGGATTGGAURGURGGGRGURGURGGATG GTGTTGUUAGGGTAAURGGATGGUARGRGAAGUXGTTRGAGGTTURGAUURGGTTARG GGGGRGUUUAGTGGAUURGGAGAGUTAUTTTGGGGAGGGGGRGGUUURGAAGAAGGA UTGGGTGGGGGRGUATGGAGRGGGGGUTGRGRGAAAAGTTTUUTGGGGRGGAGUTGAG UUARGRGGGUU |
| 3 | TTTTUTTTTTUTTTTUTTTTTTUUTTAAGGUAGAGTUTGGTTUTGTRGUUUAGAGAGRGGT AAUARGATUTUAGUTUAUTGUAAUUTUTGUUTUURGGGTTUAAGUAATTTTUATGUUTU AGGUTUUTGAGTAGUTGGAGTTAUAGGUAXGTGUTAUUATGUURGGUTAATGTTTTGTA TTTTTAGTAGAGAUAGGGTTTUAUUATGTTGGUTGGGUTGGTUTTGAAUTUUUTAUUTU AAGRGATUTGUTUAUUTUAGAUTUUUAAAATGUTGGGATTAUAGGTGTGAGUUAUUAU AUTG |
| 4 | UAGTGTGGTGGUTUAUAUUTGTAATUUUAGUATTTTGGGAGTUTGAGGTGAGUAGATRG UTTGAGGTAGGGAGTTUAAGAUUAGUUUAGUUAAUATGGTGAAAUUUTGTUTUTAUTA AAAATAUAAAAUATTAGURGGGUATGGTAGUAXGTGUUTGTAAUTUUAGUTAUTUAGG AGUUTGAGGUATGAAAATTGUTTGAAUURGGGAGGUAGAGGTTGUAGTGAGUTGAGAT RGTGTTAURGUTUTUTGGGRGAUAGAAUUAGAUTUTGUUTTAAGGAAAAAAGAAAAGA AAAAGAAAA |
| 5 | RGUUUURGGUURGUUATGGURGRGRGUUURGGAURGUTUTGGUTTUTGGGUUTGARGT TGTGRGRGUTGGGRGGGGRGGUUURGGUUTGRGAUUUURGUURGGUTGTUUUUAGRG ARGTUTGGGRGRGRGRGAGRGURGGGARGTGUAGXGRGAGATUUTGGRGGTGUTRGGG UTAUURGGGRGGUUURGGUUURGRGRGUUAUURGURGUUTUURGGUTGUURGRGTURG RGURGUTUTTUATGUTGGAUUTGTAUUARGUUATGGUTGGRGARGARGARGAGGARGG RGRGUURGRG |
| 6 | RGRGGGRGRGURGTUUTRGTRGTRGTRGUUAGUUATGGRGTGGUAUAGGTUUAGUATGA AGAGRGGRGRGGARGRGGGUAGURGGGAGGRGGRGGGTGGRGRGRGGGGURGGGGUR GUURGGGTAGUURGAGUAURGUUAGGATUTRGXGUTGUARGTUURGGRGUTRGRGRGR GUUUAGARGTRGUTGGGGAUAGURGGGRGGGGGTRGUAGGURGGGGURGUUUURGUU UAGRGRGUAUAARGTUAGGUUUAGAAGUUAGAGRGGTURGGGGRGRGRGGGUUATGGR GGGURGGGGRG |
| 7 | GTUAGRGRGRGUUATGGATUAAGATGATGAATRGUTGRGGARGGRGUAGATGRGGGRG GUURGRGGURGGGUUUURGGGTAGGGGTGGGAGGTGGAGGGGGURGRGGGGGGUURG GURGURGUUATTAAUTURGGAATTAGGTUTAAGUXGUUUAUUAUUUAGUUAUTGUUUR GGGGAGRGUUAGURGTTGGGGRGGGAGRGGGUUUAGGATGGGGAUTGAGAUUURGRGT UUUUUAUURGAAUUTGGAUUTAGUUTUUTUTGAARGUAGAGGGUAGTGGGURGUURG GAAGGGGRGGGGA |

TABLE 4-continued

Sequences Listed in Table 1

| SEQ ID NO: | Sequence |
|---|---|
| 8 | TUUURGUUUUTTURGGGRGGUUUAUTGUUUTUTGRGTTUAGAGGAGGUTAGGTUUAGG<br>TTRGGGTGGGGGARGRGGGTUTUAGTUUUUAUUUTGGGUURGUUURGUUUUAARGGU<br>TGGRGUTUUURGGGGUAGTGGUTGGGTGGTGGGXGGUUTAGAUUTAATTURGGAGTTA<br>ATGGRGGRGGURGGGUUUUURGRGGUUUUUTUUAUUTUUUAUUUUTAUURGGGGGUU<br>RGGURGRGGGURGUUURGUAUTGRGURGTURGUAGRGATTUAUTAUTGAUUAUGGR<br>GRGRGUTGAU |
| 9 | UAUURGGAUUTURGARGGUUTRGGTGTTRGUAGGRGRGGGATRGGUUUUAGUTUUUGR<br>GUUTGUUTAGGUTRGGGUURGGGUURGGGUUURGUAGGUUTGUURGUUTUUUTGGGR<br>GRGGAGUTGGGUTGRGUUAAAGUUTUUARGRGGXGUUUUGAGTUUUUURGUAGURG<br>GUAURGRGGRGGGTUTGUUUAUUURGUAUUTUUTGRGUUAGGGUUUAAGARGGGARGRGGG<br>RGGTGGTGUAGGRGGRGGGGGRGURGGGGUAGGGUAGAGGUUUUUTUUTUTATAGAU<br>UAUAUATGG |
| 10 | UUATGATGTGGTUTAUAGAGAAGGAAGGUUUTGUUTGUUURGGRGUUUURGURGUU<br>TGUAUUAURGUURGRGUTURGUTUTTGAGGUUUTGGRGUAGAAGTGRGGTGGGUAGAUUR<br>GURGRGGTGURGGUUAGGAGGAUUAGGGAXGURGRGTAGAAGGUTTTGGRGUAGU<br>UUAGUAUGRGUUUAGGAAGGRGGGUAGGUUTGRGGGGUUUGGGUURGGGUURGAGU<br>UTGAGGUAGGRGUAGGAGUTGGGGURGAUUURGRGUUTGRGAAUUAURGAGGURGTRGG<br>AGGUURGGGTG |
| 11 | ATUUTAUTTGTRGUUTUAGGRGGUUUUAGGTRGTGUUTAGGRGGATTUUTTTTTRGUUAGGUUAGGUT<br>GGUURGGGTGUATGGGGUURGGRGTGUUUTGGGGTAGAGGUTGGUUUAGGRGRGTGGGGGT<br>URGGGGRGRGURGGGTAAGGUTGGGUUAGGRGXGTGGGGTGGGGGTGUUURGGTAA<br>GGUTGGUUAGGGGRGTGGGGTURGGGGTGUUURGGGTAGGGTGGTGGUTAGGRGRGTG<br>GGGTURGUAGRGUUUUAAGTAAGGUTGGUUAGGAGRGTGAGGUUUAGGGTGUUURGG<br>ATAAGGUT |
| 12 | AGUUTATURGGGGUAUUUTGGAUUTUARGUTUUTGGAUUAGUUUTAUTTGGGGRGUT<br>GRGGAUUUUARGRGUUTAGAUUAGUUTTAUURGGGGUAUUURGGAUUUUARGUUUUT<br>GGAUUAGUUTAUURGGGGUAUUURGGAUUUUARGXGUUTGGUUAGUUTUAUURGG<br>RGRGUUURGGAUUUUARGRGUUTGGGUUAGUUTTAUUUAGGGUARGURGGGUUUUAT<br>GUAUURGGGUUAGUUTUAUUUTGGRGAAAAAGGAAUURGUUTGGARGAUTGAGGAGRGA<br>AUAAAGTGAGGAT |
| 13 | UAAGAGATTAGUAUAAUAGAUTUTUUAAURGAGGGGAAGRGTTGUUUTUARGUUAUARGRG<br>URGTAAUUAAUGGUAUGAAUUAAUUAAUUTGAUUUUAUUTGUGUTGRGAAGGAAAAAGRGU<br>AAUAAAUGGAAUURGGUAGUTGGGAGUUGUUXGUUTTUUAUUUUUUTUUUAGGGAGGT<br>TUUAAGGAGAUAURGGGGAAUGGARGGAUAUGGUUGGGUGRGUGGUAGAGGGAGGGTA<br>GGAGGUAGRGAUUAGUAGRGUUGGAGGGAGUUUAGAGAGUUAGUUUTGUGGARGGRG<br>GAATRGAAA |
| 14 | TTTRGATTURGURGTURGUAGAGGUUAGUUTUTGGAUUUUUUAARGUUGUTGGTRGU<br>TGUUTUUTAUUUTUUUTGUUARGGUUUAGUUTGAUURGUUUAUUURGGTGUTUTUU<br>TTGGAAUUTUUUTGGGGAAGGGGGTGGAGGAXGAAUAAUUUAGUGURGGUUUAT<br>TTGTTGRGUTTTTTUUTTRGAUAUAAUAAAAGUAAAUAATTGATTUAUAUUAUUAUAT<br>TARGGRGRGTAGRGTGAAAAGUAARGUTUUUUTRGGTUAGAGATUUAUTGUGUAAUU<br>TUTTG |
| 15 | UAUGGGAAAGUAAAAUUAAGGGUAAUAUUGAGGAAGUUAUUAAUAUUUAGTUUAGAAG<br>AUGUAAAGGGTUUUURGRGAAUUUGGAAGAGUUUUURGGGGUURGUUUTURGURGRGG<br>TUUUAUAUUTGUUGAUUUAUAUAUAUAUUUUXGGTUUAGGUUURGUGTGGAGAARGT<br>UUUAURGAUUUUGGGAUAGAAAGGUURGTTUAUUGUAAAARGARGTTTTTTUTATTTRGU<br>UUUUUAUUUUATGUAAUUUTGATTTUAAUUUTUUAAUUUUTURGUAUUUTGAAAU<br>AAAUUUTU |
| 16 | GAGGTTTGTTUAGGGTGRGGAAGGGUUGGAAGAGUUGAAAAUUAAAAUUTGUAUGAGG<br>GTGGGAGGRGAAAUAGGAAAAARGTRGTTTUAUAUAAARGGUUUTUTGTUUURGGAGT<br>RGGTGGGARGTUTUUAGRGGGGUUTGGAUXGGGAGAGUTGUGGTUGAGGUUAGGUAAG<br>TGTGGGAUURGRGGRGAGAGGRGAGUURGGGGGGUTUTTUAGGTUGGRGGAAGAAUUU<br>TTTGUAUUTUTAAAUUAAAUAUUAAUGAGUUUUTUAAUGUUGUUUTUAAUUUTTGUUUT<br>UUUUATG |
| 17 | GAAUUTGRGUTUUAGGAARGAUUGRGUARGUGGRGRGGRGGTGGRGGRGGRGGAGGGAUU<br>UAGGRGAAGGRGAAGGRGAAGGRGAAGGRGUAGGRGAAGGRGAAGGRGUAGGRGGRG<br>GGAAGUUARGUUAAAGURGURGURGURGURGUGUXGGGGTUTGUUUAUAGUUTGGU<br>AURGGGRGGUAGRGGTGGRGGRGGRGGARGRGGUAGGTGUAGRGAUURGRGAAGUURG<br>GGRGGURGRGRGUUUTGGGAAUUUUURGRGGUUURGAGGTGGUAGURGRGRGUUAU<br>TRGGUAGUUURGT |
| 18 | ARGGGUTGURGAGTGGRGRGGGUTGUUAUUTGGGAGURGRGGGGAGTUUGRGGAGG<br>GRGRGRGGURGUUUGGGUUTRGRGGTRGUTGUAUUTGURGRGTURGURGURGUUAURG<br>UTGURGUUURGGTGUUAGGUTGUGGGUAGAUUUXGGUAGRGGRGGRGGRGGRGGUTTTG |

TABLE 4-continued

Sequences Listed in Table 1

| SEQ ID NO: | Sequence |
|---|---|
| | GRGTAGUTTUURGURGUUTGRGUUTTRGUUTTRGUUTGRGUUTTRGUUTTRGUUTTRGU UTTRGUUTGGGTUUTURGRGURGUUAURGURGRGUUARGTGRGUAGTRGTTUUTGGAGR GUAAGTTU |
| 19 | GUAURGUTTGUUTTRGUTAGAGGAAGAAGAGARGGUUUTGAGRGUAGUAUAUUTRGG URGGTTGGAGTUTGUURGGUTGURGUUAGGGGGTGATGRGUUUTAUUUTTTUUTUUAG GATGUURGGGAUUUUAAGGAGGGTRGTGGGTUTUXGRGTUUUAAUUTGGAGUUTTGGU URGGGATGATAUUUTTGGUUAURGGUAGUAGGTUTUTGGTGGUUAUUTGARGUTTGAG UATTTUTTUTGRGGAUUUTGGGAAGTUUTAUUUUTTGGAUTAUAAAATATUTTGGTTG TUUAAAGGT |
| 20 | AUUTTTGGAUAAUUAAGATATTTTATGAGTUUAAGGGGTAGGAUUUUUAGGGTURGUA GAAGAAATGUUAAGRGTAGGTGGUUAUUAGAGAUUTGUTGURGGTGGUUAAGGGTA TAUAUURGGGUUAAGGGUUUAGGTTGGGARGXGGAGAUUUARGAUUTUUTTGGGAUU URGGGUAUUTGGAGGAAAGGTGAGGGRGUAUAUUUUTGGRGGUAGURGGGUAGA UUUAAURGGURGAGGTGATGUTGRGUUAGGGURGTUTUTTUTUUTAGRGAAGGU AAGRGGTGU |
| 21 | UTGURGUUTRGUURGRGGGAUUUUTGGAGGAGUTURGRGUUUUUUTUUUAUUUA GAGUTGURGGGRGGUTGGAGUAGUAGRGRGGGAGRGUUAGGGGUARGGGAGRGUAGT UUUTGTGGAGTRGUTGRGGGTURGRGTGGRGTGUUXGGGGGAUUUTAAAGAURGTRGG GTGGGGGTGAGGGRGAGGGGRGGGAUAURGGGGURGRGGGRGGGGRGUAUURGGAA UUURGAUAGUTGTGTUTTGGTGGAGUTGTGGAUTGRGUURGURGAUTUUUARGGURGG GGRGGRGUTGAA |
| 22 | TTUAGRGURGUUURGGURGTGGGAGTRGGRGGGRGUAGTUUAUAGUTUUAUUAAGAUA UAGUTGTRGGGGTTURGGGTGRGUUURGUURGRGGUUURGGTGTUURGUUUUTRGUUU TUAGUUUUAUURGARGGTUUUUAGGGGTUUUUXGGGUARGUUARGRGGAUURGAARG AUUUAUAGGGAUTGRGUUURGTGUUUUTAGRGUUURGRGUTGUTGUUUAGURGU URGGUAGUTUTGAGGATGGAGAGGAGGGRGRGGAGUTUUUUAGGGAGUUURGRGGGR GAGGRGGUAG |
| 23 | TGTGGTGUTGUTTGRGUTGURGGTGGUUTGGGGTGAGAGGRGGGRGGGRGTGGGGAGG RGUURGGGRGGARGAGGAAUURGGGGUUURGUAGAGAAUTRGRGTGUAGRGUTGAGUT GRGUTGUTUTGRGRGUURGGGTURGAAGGUAGRGXGATGGGTGGGUTGAGRGRGRGAU URGGUAGGGRGGRGGGTGTAGGATUUTTUTGRGUAUTGGAGAUUUTRGUTGUTTUTGG GTAAGRGTGGAGTUUUUAGGTGUAGGGGUUAAGTRGTGARGAGRGUAGTGGAAGGRG UAGATGUTGA |
| 24 | TUAGUATUTGRGUUTUUAUTGRGUTRGTUARGAUUAAGUUUTGUAUUTGGGAAUTU UARGUUAUUUAGAAGUAGRGAGGGTUUUAGTGRGUAGAAGGATUUTAUAUURGURG UUUTGURGGGTRGRGRGUUAGUUUAUUUATXGRGUTGUUTTRGGAUURGGGRGRGUA GAGUAGRGUAGUTAGRGUTGUARGRGAGTTUTUTGRGGGGUUURGGGTTUUTRGTUR GUURGGGRGUUTUUUARGUUGUUGUUTUUAUUUUAGGUUAURGGUAGRGUAAG UAGUAUUAUA |
| 25 | GUTTUUURGRGTUUTURGGGUUGGGUGUUUUTUUTUURGUAUAGTGRGGAGUAGGGA GGUUUURGRGUUTRGAUUAUURGRGUUURGAGRGTURGRGUUTUUTUUTURGUTUTGUAG GRGGGGAURGUUURGGRGUTRGGUAUURGGUAGXGRGGUUUUUTUUAGUUUURGGUTU URGGUAGUAGAAGUAGAAGGUAGRGUUAGGGGURGURGURGURGURGAGUTURGRGG GGUTRGGGAGURGGUUURGGRGAGGAGGRGRGGAAUUATGGURGATGGGGGRGAGGG RGAAGARGAGATU |
| 26 | GATUTRGTUTTRGUUUTRGUUUUUATRGGUUATGGTTURGRGUUTUUTRGURGGGGURG GUTUURGAGUUURGRGGAGUTRGGRGGRGGRGGUUUUTGGRGUTGUUTTUTGUTT UTGUTGURGGGAGURGGGGGUTGGAGGGGURGXGUTGURGGGTGURGAGRGURGGGR GGTUUURGUUTGUAGAGRGGAGGAGGRGRGGARGUTRGGGRGRGGGTGGTRGAGG RGRGGGGGUUTUUUTGUTURGUAUTGTGRGGGAGGAGGGRGGUURGGGUURGGAGGARG RGGGGAAGU |
| 27 | GUUUUUUAGGAUTGGRGGUUURGGGUUURGUTUUUAUUUAUUUAUUTARGUAGGGGG RGTUUTGUTUAGGUAAUTUUTUURGRGRGUUURGTRGGGGAURGGGRGGGGARGGGAG AAGGAAAAGGGUUUUTGGUTURGGGAUUAGGGUTUXGGAGGGTGURGGGRGGGGAGR GGAAUAGGGAARGGGUTGGTGGRGGUUUUAAGRGGGAGGGARGGAUGAUARGRGGU UUUUTGGRGGUUTGRGAUTRGURGAUUTGRGGAAUUTRGTRGURGUUUTAUAGUUU RGRGGUUAURGUU |
| 28 | GGRGGTGGURGRGGGUTGTGAGGGRGGRGARGAGGTTURGUAGGTRGGRGAGTRGUA AGGURGUUAGGGGURGRGTGTRGGTURGTUUUTUUGUTTGGGGURGUUAUUAGUUR GTTUUUTGTTURGUTUUURGUURGGUAUUUTUXGGAGUUUTGGTUURGGAGUUAGGGG UUUTTTUUTTUTUURGTUUURGUURGGTUUURGARGGGGRGRGRGGGAGGAATTGUUT GAGUAGGARGUUUUUTGRGTAGGTGGGTGGGTGGGAGRGGGGUURGGGGURGUUAGTU UTGGGGGGU |

TABLE 4-continued

Sequences Listed in Table 1

| SEQ ID NO: | Sequence |
|---|---|
| 29 | AAAATGTTTGGUAUUTUAUUGAUAUGUUUAGUGAUAUUUUGGGGUUGGGGAGGGU<br>AGUUAGGUUAGUUAGRGRGUAGGGUAGGGGRGGGRGGAGGAGAAGUUUGGAGGAGGU<br>TGARGGGAAGUUTRGAGGAGGGGUAUUURGGUTUXGAGGUTGGGUTGGGAARGUTGUTU<br>UAUAGRGUTGTGAGTGGURGGGAGGAUUUAURGUUAUUAURGUTGUUUTUTGGGGUAUU<br>TUUUAUURGUURGGGATGUTGURGUUTUUTTUUAUAATGUUTGUUGAUUAAUUUUUUA<br>AUUAAGAAG |
| 30 | UUUUUGAUUAAAAAAUUGAUAAUAGGUAUUGUGGAAAGGAGGRGGUAGUAUURGG<br>GRGGGUGGGAGAUGUUUUAGAGGUAGRGGUGGUGGRGGUAAGUUUUUURGGUUAUUUA<br>UAGRGUTGUGGAGUAGRGUUUUUAGUUUAGUUTXGGAURGGGGUGUUUUUUUUUUAGAGG<br>UUUUURGUAGUUUUUUUAGGUUUUUUUUURGUURGUUUTGUUUTGRGRGUTGGUTG<br>GUUTGGUTGUUUUUUUUAGUUUUAGGGAUGAUAGUAAAAUGAUUAAUGAGGUGUU<br>AAAUAUUUU |
| 31 | GAGUUUAGUURGUAUUUUAUAGRGUUAUAUAUUUAGGUUAGUUUAGUURGGUUUUA<br>GUUGGUTUTUGRGGAGUUUUAGUUAGUUURGRGUUUUGGUUUUGGUUUUGRGGGUGGUAU<br>AUAGAUAAGRGAURGGGGUGGUURGGAGAGGUXGUGUUUUTGGUUGRGAGARGARGRG<br>AUAGUAGGGRGUUAURGGGGGURGUAGRGGRGURGAAGGRGGUUUUGGGGGRGGGGGUT<br>UUGGUARGAGGGGGAUUUUUURGGGUUAAGUUUAUAGAGGRGGAGGGGGUUUGGGUUGR<br>GUUUUAGAG |
| 32 | UUUUGGGGRGUAGUUUAGGUUUUUTRGUUUTUTGUGAAUUUGAUURGGGAGGGUUUUUU<br>TRGUUGUAGAGUUURGUUUUUAGGGAURGUUUUUTRGARGURGUTGRGGUUUUURGGAGRG<br>UUUUGUGUTRGRGUGUUUAGUUAGGGGUAXGAUUUUUURGGGUUAUUUURGGTRG<br>UUTGUTGUGUUAUURGUAAGUAGGAUUAAGARGRGGAGUUGGUUGGGGUUUTURGU<br>AGAGAURGAUUGGGAURGGAGUUGGGUUGGUUUAGAUGUGUGGRGUUGUAGAGAUGRG<br>AAUUGGGGUUU |
| 33 | GRGGRGGGGGUUGUUUUGGGRGRGUUUUGGGRGAAGUUGRGUUUUAGUUTURGGUUUUGG<br>UUUUUUGGRGRGUUUUGAUUUUUURGGUURGUUUUUGAGUUUUAGUAGURGRGGGUUURGGG<br>AURGGUUAAGAGUAGUGUAARGUUUTGURGGAXGGAGUUUUUUUUUUTUURGGGGARGU<br>UGGGUUAUGAGUURGRGGUUAUUUGAGGUAUAGGGGAGUUGUUGGUUAGGAUAGU<br>UUUUGAAGUUURGUGUUUUUGUUUTUGUAUTGRGGGARGUUAGRGUUUGGUUUUGG<br>RGGAGGRGT |
| 34 | ARGUUUTRGUUAGGGURGAGRGUGGRGUUURGUAGUUAGAGGRGAGGGUARGGGAU<br>UUUGGGGAGGUUGUUUGGURGAGUAGAUUUUUUTGUGUUUUAGGUUGGURGRGGAGUU<br>UAUGGUUUAGRGUUURGGGAAAGGAAAGGAUUUXGUURGGRGAGGRGUUGUAGUUAUU<br>UUUAGURGAUUURGGGAUURGRGGUUGUGGGUUAGGGGGGRGGUURGGGAAGUURGGGRG<br>RGURGAGGGGURGGGGURGGAGAUUGGGGRGUAUUUURGUURGGGGRGRGUUUUAGAGUA<br>GUUUURGURGU |
| 35 | AAAUGGUGAAAUAUUUUUAAAAAUAUGUUUUUUAAGGUUAAUUUUGRGGUUGGUAGUU<br>UUUUURGARGUUUUGUUUUUAGAAAAUAUAAUAAAGRGAUGGAAAUUAGUUAR<br>GGUUURGGGAAGAAGGAGUAGUAGUGAGGUUUXGGAAUUUAUUGRGGURGAAAUUGU<br>UAUGUUUUUUTTAAUUAAAAUAAAAAAAGAUAAGAAGAAGAAGAAGUAAAAAUUUUUTAAUAU<br>AUUAAAUAUARGGAAUUUUAAUUUUUAAAGRGAUAUAUUGUUUAUUAUUUUUAGUAUAUGA<br>RGUAAAUU |
| 36 | GGUUUARGUUAUGUAUAAAAUAAUAGAUAAUGUAURGUUUAAAGAUUAAAAUUURGUA<br>UAUUUGAUGUAUUAAAGGGUUUUAUUUUUUUUUUUAUAUUUUUUUAUUUGGUUAAAGAGA<br>GUAUGGUAGUUURGGURGUAGUGGGUUUXGGGGUUUAUUGUUAUUUUUUUUUUURGGG<br>AURGUGGUUGAAUUURGAUURGUUUGUUGUGAUUUUUUGGGAGGUAAAGGRGURGGAA<br>GGGGUUAUUAGURGRGAAGUUGGUUUUGGGGAAUAUAUUUUUAGAGGAUAUUUAUUAU<br>UU |
| 37 | GUGGUAGGGGUAAGGRGUUUUAUUUGUUGAAAGGUUGUGUUUUAUAUAAAAAUAGA<br>AAUUGGUUGUAUGUAUGUAAAGGAUGGUUGAGUGGUAAUAAUUGGAGGAAUUGRGGAU<br>AGURGGAGGGUUGRGGGGURGGAGGGGUUUUUGGGUUXGGUAUUUTGUUUUAURGGAGGUUU<br>UAUAGGGUUUUUTUUAUUUAGGGUUGGGURGGUAAGUUUUGUUUAUAGRGAUUUGGGUUA<br>AGUUUGUAUUUUUUAUGAUUUAUUUGURGAAAUUAAGUUARGUUUGGGUAAGUAUA<br>UUUUGUAUA |
| 38 | UGUGUAGAAUGUAUUUAUUUAGGRGUGGUUUGAGUUURGGUAAGUGAGGUUAUAAAAG<br>UAGUAGGUUGUUUUAGAUGUGAUUAGGUUAGAUUUGURGGUUUUAUUUUGGAUGGAGGA<br>GGUUUUGUGGAUUURGGUGGGGUAGAGUAUXGAUUUAAAGAUUUUUURGGUUUUURGUA<br>GUUUURGGUGUUGURGUAGUUUUUUUAGUUAUUAUUAUUUAGUUAUUUUUUUGUAUGUAUG<br>UAAUUAGUUUUUAUUUUUUUGUGUAGGGUAGAGUUUUUUAAGGUAAAUGGAAGRGUUUUAUU<br>UUUGUUAUU |
| 39 | AUUUUGGAAGUGUGUAARGGGURGUUGUGUAGGGUUGGAUGGUUGUUUGAUUUUUUGAUUUGAA<br>AAUUAGUUGGGGGGUUGGGGAGRGGAGGAAGGAUGGRGGAAGAGAGGGAAAGAGUUARGA |

TABLE 4-continued

Sequences Listed in Table 1

| SEQ ID NO: | Sequence |
|---|---|
|  | GAAUAAUTAGGRGGGATGTAUTTTTGAGUUUTGUXGGGTGTUTURGATRGGAGTUTGGG GTTGAGATTTGGGUTGUAUTTGTUUURGGTGTGTUTUTURGGRGGAGTAUUUTGAAGGT GUARGAGGTGGGGAGUATAGGUTGAGGTGGGTAATRGGGTUUTGGATAGAAAUAUAAU UUTRGTUU |
| 40 | GGARGAGGGTTGTGTTTUTATUUAGGAUURGATTAUUUAUUTAGUUTATGUTUUUUAU UTRGTGUAUUTTAGGGTAUTURGURGGAGAGAUAUAURGGGGAUAAGTGUAGUUUAA ATUTUAAUUUUAGAUTURGATRGGAGAUAUUXGGUAGGGUTUAAAAGTAUATUURGUU TAGTTGTTUTRGTGGUTUTTTUUTUTUTTURGUUAUUUTTUUTURGUTUUUUAGUUUUUA AUTGTTTTUAGGTUAAAAGGTUAAAUAUUAUUUAUUUGUAUAARGGURGTGUAUAUTT UUAGAGT |
| 41 | AAAGAUUTGGTTUUAGAAURGURGUAAUAAGTGGAAGRGGUAGUTUTRGGUTGAGUTG GAGGRGGUUAAUATGGRGUARGRGTRGGRGUAGAUTUTGGTGAGUATGURGUTGGTGT TURGGGAUAGTTRGUTGUTGRGRGTGURGGTGUXGRGUTRGUTRGUUTTTUURGRGURG UTUTAUTAUURGGGAAGUAAAUUTUTRGGUUTAUUTUTUTAUAAUUTATAUAAUAAGU TRGAUTAUTGAURGGUURGURGUUURGRGURGUUUUUAGUTGUURGUAGAGURGGGRG RGTAUTGTA |
| 42 | TAUAGTARGRGUURGGUTUTGRGGGUAGUTGGGGGRGGRGRGGGGRGGRGGGURGGTU AGTAGTRGAGUTTGTTGTATAGGTTGTAGAGAGGTAAGGURGAGAGGTTGUUTUURGGG TAGTAGAGRGGRGRGGGAAAGGRGAGRGAGRGXGGUAURGGUARGRGUAGUAGRGAA UGTUURGGAAUAUUAGRGGUATGUTUAUUAGAGTUTGRGURGARGRGTGRGUUATGT TGGURGUUTUUAGUTUAGURGAGAGUTGURGUTUUUAUUTGUUGRGGRGGTUTGGAAU UAAGTUTTT |
| 43 | UUAGRGUAUAGUURGGUUAGGGGRGUUUTUUUTGURGURGURGGUUUTTTGATRGUUR GRGGUURGRGGUURGUAGAUUAUAGUUAGRGUTGTGUGGUAGGTGGRGGUAGRGG GGRGGRGGRGRGUTUAGGRGUARGGGTUUURGGGUXGRGGRGRGUTUUURGUUARGURG UAUATUAAGGUURGGURGURGGRGGGRGUUTTAATTAGUAGUUTGAAATTATAATAT TATGTTAAAGAAUAAAGUTGUTUUURGGAAAATATGTGUTGUATATUTGAUAAAGAT AAATTGGATTA |
| 44 | TAATUUAATTTATUTTTGTUAGATATGUAGUAUATATTTTURGGGGAGUAGUTTGTTU TTTAAUATAATATTATAATTTUAGGUTGUTAATGAAGGRGUURGURGGURGGURGGGU TTGATGTGRGGRGTGGRGGGGAGRGRGURGXGGUURGGGGAUURGTGRGUUTGAGRGR GURGRGUUURGUTGURGUUAUUTGUUUAGUAUAGRGUTGGUTGTGGTUTGRGGGURGR GGGURGRGGGRGATUAAAGGGURGGRGGRGGUAGGGAGGGRGUUUUTGGURGGGUTG TGRGUTGG |
| 45 | URGTUURGGGUTUUTGGRGGUTGTRGUTGRGGTTUUTTUURGRGGGURGGGUUUUTTUU UTGRGUUTTRGURGUUTUUTRGRGUUTGUURGGGGUURGUAGUUTURGUAURGGGAAU URGGAGGAUURGAGGRGGGRGUAGGGGRGAAGUXGGGGURGGGGAGGGGURGUUTRG UTURGGGTTRGAGARGGAAGAAAUARGRGGRGUAGGUTURGGAGRGARGGUTURGARG GGGAUURGTTAAATAATTTATTGATGATAUAAAGRGAUTRGRGUUUAUURGGGGURGU UUURGGATTU |
| 46 | GAATURGGGGGRGGUUURGGGTGGGRGRGAGTRGUTTTGTATATUAATAAATTATTTA ARGGGTUUURGTRGGAGURGTRGUTURGGAGUUTGRGURGRGTGTTTTUTTURGTUTRGA AUURGGAGRGAGGRGGUUUTUUURGGUUUXGGUTTRGUUUUTGRGUURGUUTRGGGT UUTURGGGTUUURGGTGRGGAGGUTGRGGGUUURGGGUAGGRGRGAGGAGGRGGRGAA GGRGUAGGGAAGGGGUUURGGUURGRGGGAAGGAAURGUAGRGAUAGURGUUAGGAGU URGGGARGG |
| 47 | UTTGTUUAGGARGURGURGGURGGGGUTGUAAGGGAGGGGAAGGGAGGGAGGTUAGR GGURGGRGGGGTUUUUUTURGRGUUUAUURGUUURGUAUUUURGRGRGGGGUUAUTU AUURGGGUUAGUUAGARGRGGGTUUUTUUAGGGRGXGUUUTGUAUUARGURGGGUUA GAAGATGGGRGGGRGUUURGGUAGUTRGGUUAGGGGUTTGGGGTAGURGRGRGUUAUA GRGGURGRGGGUURGAAGTAAAARGURGGRGGARGARGRGAGUURGTTGAGURGGGGUA GUUUUUUUAGGAG |
| 48 | UTUUTGGGGGGUTGUUURGGUTUAARGGGUTRGRGTRGTURGURGGRGTTTAUTTRGG GUURGRGGURGUTGTGGRGRGRGGUTAUUUUAAGUUUUTGGURGAGUTGURGGGGRGU URGUUUATUTTUTGGUURGGRGTGGTGUAGGGXGRGUUUTGGAGGGAUURGRGTUTGG UTGGUURGGGTGAGTGGUURGRGRGGGGGGTGRGGGRGGGTGGGRGGAGGGGAU UURGURGGURGUTGAUUTUUUTUUUTTUUUUTUUUTTGUAGUUURGGUGGRGGRGTU UTGGAUAAG |
| 49 | UTURGGGUUTUATUTTUTURGTGGAGGTGUUUTTUAGUAAGTTTGUUAAUAAUAURGAGG GUUAGTGRGGTGAGGUUAUAGGGUTUURGGGUATRGTUTGGUATTRGRGGGGGRGGGG GTGURGGGUAGGGRGAGGUUAUUARGTGURGXGTGTGURGGTGUTUTGUTTTUTGG UTGUTUTGUTGAGTGUAGGUUAUAGGUATGAGGUUTARGUUTGURGGTAUUTGUAGUT UUUUAGTAUUATAGGGAUTGUUUAGGGTTGUUTGRGGGGAUAGTGAGGUATAGGUA GGGUURGUT |

TABLE 4-continued

Sequences Listed in Table 1

| SEQ ID NO: | Sequence |
|---|---|
| 50 | AGRGGGUUUTGUUTGTGUUTUAUTGTUUUURGAGAAUAAUUUTGGGAUAGTUUUTATG<br>GTAUTGGGGAGUTGUAGGTAURGGUAGGRGTAAGUUTUATGUUTGTGGUUTGUAUTUA<br>GUAGAGUAGUUAGAAAGUAGAGAUAURGGUAUAXGRGGUARGTGGTGGUUTRGUUUU<br>TGUURGGUAUUUURGUUUURGRGAATGUUAGARGATGUURGGGAGUUUTGTGGUUTGA<br>URGUAUGGUUUTRGGTGTTGTTGGUAAAUUTGUTGAAGGGUAUUTUAARGGAGAAGA<br>TGAGGURGGAG |
| 51 | UUAURGRGGUUTTTUAUUUAAURGUUUUUTUUTGRGTGGGGGUUURGUAUUUUTGG<br>AUTGGRGTGGGUTUTGGGGUURGATGUUUTGGUAGUUURGGUUAUTUTUGURGUTGGU<br>RGRGGGTAUUTGUTUAUUTGUUARGURGTGGUXGAUURGGGGAUAURGAUAGURGG<br>GUUATGUUTRGAGTUURGURGUURGRGURGUTGUTRGGUUTUTAGAAARGUAUUUU<br>ARGURGUUAGURGGGGUTUUAGGGUUAURGUUURGGGUURGGAGGAUTGGRGAUTUU<br>UTURGAGGUTG |
| 52 | UAAUUTRGGAGGGAGTRGUUAGTUUTURGGGUURGGGRGGTGGAUUUTGGAGUUURGG<br>UTGGRGGRGTGGAGGTGRGTTTUTGAGAAGURGAGUAGRGGRGRGGGRGGGGAUTR<br>GAGGUATGGUURGGUTGTRGGTGATUUURGGGTXGGUUARGGRGTGGAUAGGTGAGUA<br>GGTAUURGRGGUUAGRGGUAGAGATGGURGGGGUGUUAGGGUATRGGGUUUUAGAG<br>UUUARGUUAGTUUAGGGGATGRGGGGUUUUUARGUAGGAGGGGGRGGTTGGGTGAAA<br>AGGURGRGGTGG |
| 53 | ATGUTAGTGUAGTTUUUTGRGUAGURGUUAGGTGGRGTUAAGGURGURGUUTGGGGGG<br>URGGGUAGGURGAGGUUUUTGUURGTRGUAGTUUUAGUUTRGUUAUUAUTUGGUURG<br>GGAGUUGGUTGRGGGUAGRGGUTUGGUAGUUTGXGGURGGGGGRGGARGGTGGGGRGG<br>TGTGGGUUUAGUUUUURGGAGGGUUUUARGGUTGAGUAAARGTTRGGGUTGATGTR<br>GGUAAUATGRGGAAUUAATTTTRGGGGAAUUAGUAGUUAAAUUAUUUAUUTTGGGR<br>GGGAAGUAG |
| 54 | UTGUTUURGUUUAAAGGTGGATGGTTTGGUTGUTGAGTTUUURGAAAATTGATTURGU<br>ATGTTGURGAUATAGUUURGAAURGTTTGUTUAGURGTGAGGGUUUTRGGGGAGGUTG<br>AAAUUUAUAURGUUUUAURGTURGUUUURGGUXGUAGGUTGUUAAGURGUTGUURGU<br>AGUUAAUUURGGGUUAAGTGGTGAGRGAGGUTGGGAUTGRGARGGGUAGGGGUUTRG<br>GUUTGUURGGUUUUUUAGGRGGRGGUUTTGARGUUAUUTGGRGGUTGRGUAGGGAAUT<br>GUAUTAGUAT |
| 55 | GGAGRGGTGRGGAGGUAGUUAGGUUURGUURGURGUAGURGRGGUAGURGURGGAGG<br>ATTUUTGTUUTAATATGGAGUTGGGATTUUUURGGUUURGUUURGUUUURGGUURGR<br>GGGGAGAUAGAGGGUTGGUAGUAGGGRGGGGGGAAGXGUTRGUTTGGGGGURGGUAAR<br>GGGGGGAAGGGATGUUTAAGTGUAGAUUUAGGTUUTRGURGTGUUUUARGTUUUTGU<br>UTUAGTTTUUUUTTAGTAAGGTTAATTAGUTGAGAGGGAAAUUARGAATUAUTGUAG<br>AUTAUAGRGUTG |
| 56 | UAGRGUTGTAGTUTGUAGTGATTRGTGGTTTUUUTUTUAGUTAATTAAUUTTAUTGAAG<br>GGGAAAUTGAGGUAGGGARGTGGGGGUARGGRGAGGAUUTGGGTUTGUAUTTAGGUAT<br>UUUTTUUUUURGTTGURGGUUUUUAAGRGAGXGUTTUUUUURGUUUTGUTGUUAGUUT<br>UTGTUTUUURGRGGGURGGGGRGGGGRGGGURGGGGAAUUUUAGUTUUATATTA<br>GGAUAGGAATUUTURGGRGGUTGURGRGGUTGRGGRGGRGGGGUUTGGUTGUUTRG<br>UAURGUTUU |
| 57 | RGGAGTGGAGUTTGGGAAUUUUTRGGUUAAGUAUAGRGGTTRGAAAATAUAGUTGAA<br>AUUUAGRGGGUUUTAGUARGRGUUUUAGRGURGGAGUAGGGUUAGGGTUTUTTTGRG<br>AUURGGUTRGUTUUAGATUUUUUUAGUTUTRGGXGGRGGAUURGGGURGRGTGTGAG<br>RGRGUTTTGUAUTUUTATUUUUAGGGUURGURGAGAGUUARGATTTTTTAUAGAAAAT<br>GAGUAATAAAGAGATTTTGTAUTGTUUTGAUTGGGGAGTUUUAGGURGRGGGGGARGG<br>AGRGUUUUT |
| 58 | AGGGGRGUTURGTUUUURGRGGUUTGGGAUTUUUUAGTUAGGAUAGTAUAAAATUTUT<br>TTATTGUTUATTTTUTGTAAAAAATRGTGGUTUTRGGRGGAUUUTGGGGATAGGAGGTG<br>UAAAGRGRGUTUAUARGRGGUURGGGTURGUXGURGAGAGUTGGGGGGATUTGGAGRG<br>GAGURGGGTRGUAAGAAGAUUUTGAUUUTGUTURGGRGUTGGGRGRGTGUTAAGGGU<br>URGUTGGGTTTUAGUTGTATTTTRGAAURGUTGTGUTTGGURGAGGGGTUUUAAAGUT<br>UUAUTURG |
| 59 | AAAAATAUUUTAGATTUATAAAUAAAAGUTTGUAGTTAUUUAUAGUUUAATAUAAARG<br>AUURGARGUUUTAUTTUTATAGUURGTGAGTUTUUUAGUUUUTAAUAGGUTRGTUTU<br>UUUAGARGUUURGGGTGAAAAGGTTRGRGURGUXGGTGGAGAGTUUTATTGGTTUTATT<br>TUTGTUTTUAUTUUAAGGUUUUAGGAURGGGGAGAGGTUUTGGTUTAAUUTTGGUTGTU<br>UUARGGTUUAAGGAUUUTAGRGUTAGUUUGAAARGUTAAGUUAAGRGTGGAGAURG<br>URGGGRGUA |
| 60 | TGRGUURGGRGGTUTUUARGUTTGGUUTAGRGTTTRGGGUTGAGRGUTGAGGTUUTTGG<br>AURGTGGGAUAGUAAAGTTAGAUUAGGAUUTUTUUURGGTUUTGGGGUUTTGGAGTG<br>AAGAUAGAAAATAGAAUUAATAGGAUTCUUAAUXGGRGGRGRGAAUUTTTTAUUTRGGG |

TABLE 4-continued

Sequences Listed in Table 1

| SEQ ID NO: | Sequence |
|---|---|
| | GRGTUTGGGGAGARGAGUUTGTTAGGGGUTGGGAGAUTUARGGGUTATAGAAGTGAGG<br>GRGTRGGGTRGTTTGTATTGGGUTGTGGGTAAUTGUAAGUTTTTGTTTATGAATUTAGGG<br>TATTTTT |
| 61 | AGUUARGAUTUTGUUUTATGGGGUUUAGRGRGUAUTTGGGTGRGGGTGATUUUTUR<br>GGAAGTRGUTUTGUTUUTUTGGURGGGTUTUUTUUTUTUURGGUUAUTTATAUUUTTG<br>AGUAUUAAGAGTTRGUUUATTTAGGURGUUTUXGGGAARGGAAGGGTUUAUUUUAURG<br>UUAGGUTUTUAAAGGGTGGGGTGGRGUUTRGGGTGGGGRGGGUAGGAGGTGGGTGAGG<br>ARGGGAGAGAAGGGGRGAGRGGGGGUARGGGGRGGGGURGGUTUAGTRGGGGTAGAT<br>GATGAAGURG |
| 62 | RGGUTTUATUATUTAUUURGAUTGAGURGGUUURGUUURGTGUUURGUTRGUUUUTT<br>UTUTUURGTUUTUAUUUAUUTUUTGUURGUUUUAUURGAGGRGUUAUUUAUUUTTG<br>AGAGUUTGGRGGTGGGGTGGAUUUTTURGTTUUXGGAGGRGGUUTAAATGGGRGAAUT<br>UTTGGTGUTUAAGGGTATAAGTGGURGGGAAGAGGAGGAGAUUGGGUUAGAGGAGUA<br>GAGRGAUTTURGGAGGGATAUUURGUAUUUAAGTGRGRGUTGGAUUUUATAGGGGUAG<br>AGGTRGTGGUT |
| 63 | URGUTTGGGTAAURGUAGUUTGUUTGRGTUTUTTUUTTUUTURGRGTGGGTTUTAGUAA<br>UATUUAUTGUAGURGGGUUAGGRGAGURGGRGRGTAUUATRGGRGRGGGGGGAGGAG<br>AGGGURGGGUUTGGGAAGATGUTGXGGAGGAXGTUGXGGATTXGXGAGUURGGGGTA<br>AGGRGGRGRGUAURGUUUUTUURGURGUTTUUUUUUUAUUURGUUUUUAURGUR<br>GUUUTTAGUUUTUUUURGGGATGAGAGAGAGTRGRGUTGRGGAGUAAUUUUAGTGGAT<br>GGGTURGRGGGG |
| 64 | UUURGRGGAUUUATUUAUTGGGGTUGUTURGUAGRGRGAUTUTUTUTAUUURGGGGG<br>AGGGUTAAGGGRGGRGGTGGGGGGRGGGGTGGGGGGGAAGRGGRGGGAGGGGGRGGT<br>GRGURGURGUUTTAUUURGGGUTXGXGAATUXGUAGXGTUUTUXGUAGUAUUUUUA<br>GGUURGGUUUTUTUUTUUUURGRGURGATGGTARGRGURGGUTRGUUTGGUURGGUT<br>GUAGTGGATGTTGUTAGAAUUUARGRGGAGGAAGGAAGAGARGUAGGUAGGUTGRGGT<br>TAUUUAAGRGG |
| 65 | ATUTUUUTTUTGUUTGTGATATGGRGGGUTGUATTAUAAGUTGGGRGTRGAGATAAAG<br>RGGGGAGURGRGGGARGGRGGUUUAGRGURGGGGUUURGGGTGGGGURGGUUAGGGA<br>GATAAGGGUUUUUAGUUUUATGAATTATTUAUXGGUAUTGUUTUUTUTGGUTGGGRG<br>GURGUUUTGGGRGUTGAGATTGRGTUTTUUAGAGGGGUUTGGGTAGGGTGGGAGGGGG<br>GTURGTGGGGAAGGGUAGUAGGUTGUAGAGGGGTUTTUUTATGGGGGATGGGGAGAGG<br>GGAGGAUTGT |
| 66 | AUAGTUUTUUUTUTUUUUATUUUUUATAGGAAGAUUUTUTAUAGUUTGUTGUUUTT<br>UUUUARGGAUUUUUTUUUAUUUTAUUUAGGUUUUTGGAAGARGUAAUTUTUAGRG<br>UUUAGGGRGGURGUUUAGUUAGAGGAGGUAGTGUXGGTGAATAATTUATGGGGUTGG<br>GAGGUUUTTATUTUUUTGGURGGUUUUAUURGGGGUUURGGRGUTGGGURGURGTUUR<br>GRGGUTUUURGUTTTATUTRGARGUUUAGUTTGTAATGUAGUURGUUATATUAUAGGU<br>AGAAGGGGAGAT |
| 67 | AGGTUATUUAGUAGUAGGGUTUUARGTRGGTUTRGTRGATGUUUUAGAAGGUUAGTUU<br>UTUUTRGAAGAGRGGUURGUAUARGTUTGRGGGGUAGTGUAGUTTGURGGTGRGGTAG<br>TAATTGAGUAUATAGGRGAAGARGUUURGGGTGUXGGTRGAAGAAGAAUTRGRGGURGU<br>UAURGGGATGGTRGUTGGUUUTGURGURGRGGGAAUTGUAGTTGUURGRGURGUUUTR<br>GAAGUAGURGUUTGGUURGGGGGAUAGRGGGGGRGUTUTRGGRGGRGGRGAUAGTGG<br>AGGRGGRGARG |
| 68 | RGTRGURGUUTUUATGTRGURGURGURGAGAGRGUUUURGUTGTUUUURGGGUUAGG<br>RGGUTGUTTRGAGGGRGGRGRGGGUAATGUAGTTUURGRGGRGGUAGGGUUAGRGAU<br>UATUURGGTGGRGGURGRGAGTTUTTUTTRGAUXGGUAUURGGGRGTUTTRGUUTATGT<br>GUTUAATTAUTAURGUAURGGUAAGUTGUAUTGUUURGUAGARGTGTGRGGGURGUTU<br>TTRGAGGAGGAGTGGUUTTUTGGGGUATRGARGAGAURGARGTGGAGUUUTGUTGUT<br>GGATGAUUT |
| 69 | RGTATTAAUAGGTUUUUTURGRGUAUAUTGAUATATTUTTATUUUUATAATGAATT<br>UAGUUATATGGUATUTTTUUUATRGAAGGUUATRGGGAATGGUTTTAGGAAGUTGATT<br>TTUAAGUTTTAAGRGGUAGUAGGTGURGGUAGXGRGGGGAURGATRGATGGAGAGAAG<br>GRGGGUAAGARGURGGGAAGRGUATTUUTUUTUAAURGAGTGUUAUAAURGUUUTUUR<br>GAAGTGUUURGGGGUUTRGAGUATAUUTRGRGGTAAURGGGAGGGTGGAGGGATGR<br>GGUTGGAU |
| 70 | GTUUAGURGUATUUUTUUAUUUTUURGGATTAURGRGAGGTGATGUTRGAAGUUURGG<br>GGUAUTTRGGGAGGGRGGTTGTGGUAUTRGGTTGAGGAGGAATGRGUUUURGGRGTUT<br>TGUURGUUTUTUTUUATRGATRGGTUUURGXGUTGURGGUAUUTGUTGURGUTTAAAG<br>UTTGAAAATAGUTUUTAAAGUUATTUURGATGGUUTTRGATGGGAAAGAATGUUATA<br>TGGUTGAATTUATTATGGGGGATAAGAAAATATGTUAGTGTGRGRGGAGGGGAAUUTGTT<br>AATARG |

TABLE 4-continued

Sequences Listed in Table 1

| SEQ ID NO: | Sequence |
|---|---|
| 71 | GTUTUTGUTATUUAGGUUTATGAGAAUTAAGUTTTTAURGTTUUUTTTGGGGUUTGGAT<br>AGTTTTUAAGUTGUUTTUTUUTUAUAUUATGTGAGUTAGAGURGGUUAAGAAAAUUAGG<br>GAGAUAUTUTUUUUUUAGUUTGGUUUAGAUTTUXGGGUUUUAUUUUAGGAGAGAGUUT<br>UUUAUTUTGGUUAGUTGUUUTGUAAAGUUTTRGUUUUAUUURGUUUUAATTTUTUUTTA<br>TGUUTGGUTUATUTUTTAGGGGUTGAGTTGGGAGATAAGAUTTGGGGUTTGUAGUTGUTG<br>GGGATUATT |
| 72 | AATGATUUUUAGUAAUTGUAAUUUUAAGTUTTATUTUUUAAUTUAGUUUUTAAGGAAT<br>GAGUUAGGUATAAGGAGAAATTGGGGRGGGGTGGGGRGAAGGUTTTGUAGGGUAUTGG<br>UUAGAGTGGGAGGUTUTUTUUTGGGGTGGGGUUXGGAAGTUTGGGUUAGGUTGGGGGG<br>AGATGTUTUUUTGGTTTTUTTGGURGGUTUTAUTUAUATGATGTGAGGAGAAGGUAGUT<br>TGAAAAUTATUUAGGUUUUAAAGGGAARGGTAAAAGUTTGATTUTAUAGGUUTGGAT<br>AGUAGAGAU |
| 73 | GRGURGGGUUTARGAAGUUTGGGURGGGGGURGGGGGRGGGGARGRGGGAUURGG<br>GGARGRGGGGRGUTAGUUAGGUUUUUTUUAGURGRGURGGGGURGTUURGAGURGR<br>GRGUAUAAARGGATGGGURGGTGURGUUTGURGGGXGRGRGGGGTRGGTGUUTUTG<br>RGTGGRGRGRGTGTUUURGGGTUTURGTGRGGURGGRGUATTGGUUTRGRGUTUTURGG<br>AGGGGAUTGAGUAGGTGAAUAGGUUURGGAGUUTGTRGTGGAGGGGUURGGGAAGGUU<br>TRGUTGUAGAAG |
| 74 | UTTUTGUAGRGAGGUUTTUURGGGUUUUTUUARGAUAGGUTURGGGUUTGTTUAUUTG<br>UTUAGTUUUUTURGGAGAGRGRGAGGUUAATGRGURGGURGUARGGAGAUURGGGGA<br>UARGRGRGUUARGUAGAAGGUAURGAUUUURGRGXGUURGGUAGGRGGUAURGGUUU<br>ATURGTTTGTGRGRGRGGUTRGGGARGGUUURGGRGRGGUTGGAGGGGGUUTGGUTGA<br>GRGUUURGRGTUUURGGGTUURGRGTUUURGUUUUURGGUUUURGGUUUAGGUTTRGT<br>AGGUUURGGRGU |
| 75 | GUAUAAARGGATGGGURGGTGURGUUTGURGGGRGRGRGGGGGTRGGTGUUTUTGRG<br>TGGRGRGRGTGTUUURGGGTUTURGTGRGGURGGRGUATTGGUUTRGRGUTUTURGGAG<br>GGGAUTGAGUAGGTGAAUAGGUUURGGAGUUTGTXGTGGAGGGGUURGGGAAGGUUTR<br>GUTGUAGAAGUAGGATGGGAGUAGGATURGUAGGGATGRGUAGRGGGGTURGRGGAG<br>UTUURGGRGGGGRGRGTTTUUAGGURGGGGAURGRGGTGUUAGUUUUTGUUUTRGRGG<br>ATRGGGTUTRG |
| 76 | RGAGAUURGATURGRGAGGGUAGGGUTGGUAURGRGGTUUURGGUUTGGAAARGRGUU<br>UURGURGGGAGUTURGRGGAUUURGTGRGUATUUUTGRGGATUUTGUTUUUAUUTG<br>UTTUTGUAGRGAGGUUTTUURGGGUUUUTUUAXGAUAGGUTURGGGUUTGTTUAUUTG<br>UTUAGTUUUUTURGGAGAGRGRGAGGUUAATGRGURGGURGUARGGAGAUURGGGGA<br>UARGRGRGUUARGUAGAAGGUAURGAUUUURGRGRGUUURGGUAGGRGGUAURGGUUU<br>ATURGTTTGTGU |
| 77 | UTTRGGGUAGURGAGGGRGRGGGATGAUTRGGGUAGGRGTGTGGUUTURGAUTGAUUA<br>GGGTUGGGUURGGGAUUAGAGUTTGUTTGGAAGTTUTUTGGGTGGUAGAGAUTRGGGU<br>AAURGGAGUUTGAGUUTUURGRGGGGAAGAGUTXGGAUTURGGAGGTRGRGURGUUTT<br>GGGUTTGAATTUAGTUUTTUUTTAUTAUTRGTGGUTTTGUTTAUATUATTTAAUTUTUUA<br>TTTUUTTGTUTATAUAGTGGGUTAUAAGGAGGRGGTAAGGAGATGATGATGTUTTTGA<br>AGAGTT |
| 78 | AAUTUTTUAAAGAUAUAUAUUTUUTTAURGUUTUUTTATGAGUUUAUTGUAUAGAUA<br>AGGAAATGGAGAGTTAAATGATGUAAGUAAAGUUARGAGUAGUAAGGAAGGAUTGAAT<br>TUAAGUUUAAGGRGGRGRGAUUURGGAGUUXGAGUTUTTUUURGRGGGAGGUUAGG<br>UTURGGTTGUURGAGTUTUTGUUAUUUAGAGAAUTTUUAAGUAAAGUTUTGATUURGG<br>GUUUAAUUUTGGUUAGTRGGAGGUUAUARGUUTGUURGAGTUATUURGRGUUUTRGGU<br>TGUURGAAG |
| 79 | URGUAGUUAUTAUTRGUUUUAUUTTUTAUUTURGAGGGGTTGAAUURGAGTTGTUTGT<br>TGGGGTTTAGGGAUTAGGATRGGGTUTGAGGGAUTTRGAUATAAGTGRGTGGRGGTAG<br>TGGGTATAUAGGGGAGGGGGGURGGGUUUUTXGUTUUTTUTGGAAAURGGGUUUUAUT<br>TGUAGGUURGGUUAUUTTGGGTTUTGGTGGURGAAGURGGAGUTGTGTTTUTRGUAGAU<br>TRGGGGAGUTAUATTGTGRGTAGGUAATTGTTTAGTTTGAAAGGAGGUAUAUTTUAUUA<br>RGUAGU |
| 80 | GUTGRGTGGTGAAATGTGUUTUUTTTUAAAUTAAAUAATTGUUTARGUAUAATGTAGUT<br>UUURGAGTUTGRGAGAAAUAUAGUTURGGUTTRGGUUAUUAGAAUUUAAGGTGGURGG<br>GUUTGUAAGTGGGGUURGGTTTUAGAAGGAGXGAGGGGUURGGUUUUUUTUUUUTGT<br>ATAUUUAUTAURGUUARGUAUTTATGTRGAAGTUUUTAGAUUURGAUUUTGAGTUUUT<br>AAAUUUUAAUAGAUAAUTRGGGTTUAAUUUUTRGGAGGTGAGAAGGTGGGGRGAGTAG<br>TGGUTGRGG |
| 81 | UTUUUTGRGGUTUUAUTAGTTTUTTRGUUURGUUUAGURGUUUAUTUTTUTRGGUTAG<br>GGAAGAAGAUUAGAGGGTGUUTAGUTGGAAAUTUTGGTGUTUUTAGUTTAGGGUUTUU<br>TURGGGAAGAGUTAAUTGUTUUUAGGTGAAGUXGGTGUURGRGGGRGGTURGTAUAUU<br>URGUAGURGGUTRGUAURGUTRGAGAGUUTRGGURGUTGTGTUTTUARGTUTGUAGUT |

US 11,242,568 B2

59 60

TABLE 4-continued

Sequences Listed in Table 1

| SEQ ID NO: | Sequence |
|---|---|
| | UAGUUAGGGRGRGUAGGGRGAGTGGGGTUUAUTGGRGGGTAAAGGGGAUUAGGARGG RGAGGATGG |
| 82 | UUAUUUTRGURGTUUTGGTUUUUUTTTAUURGUUAGTGGAUUUUAUTRGUUUTGRGRGU UUTGGUTGAGUTGUAGARGTGGAAGAUAUAGRGGURGAGGUTUTRGAGRGGTGRGAGU RGGUTGRGGGGTGTARGGAURGUURGRGGGUAUXGGUUUAUUTGGGAGUAGTTAGUT UTUURGGAGGAGGUUUUTAAGUTGAGAUAUUAGAGTTTTUUAGUTGAGUAUUUTUTGG TUTUUTTUUUUTAGURGAGAAGAGTGGGRGGUTGGGRGGGGRGAAGAAAAAUTAGTGGAG URGUAGGGAG |
| 83 | TAUAUAUGUAUARGUGUGUAUAURGGUUUTRGRGAGGRGGUUURGRGGGGUUAUAGRGR GGUAGRGUAGGURGRGGGGUAGGGGUUUAGUUGGGGUUUGUUUAUGUUURGGUAGUAGG AUGUAGGRGAGRGGRGGUUGUAGUUXGGGGUUGGGUUAXGRGUUGUAGUUGUARGGGA UUAUGUAGUUURGGGUUGUURGGGUUGGGGUGRGAGUGRGUGUGUUUUURGGRGGRGGR GGURGURGUUGUAGURGURGURGURGRGURGTGGAAGGRGUUURGRGUURGRGGUTRGGG UAGUUUAGU |
| 84 | GUTGGGUUAUURGAUURGRGGGRGRGGGRGUUTUUARGGRGRGGRGGRGGRGGUTGUA RGGRGGURGURGURGURGGGGGGUAUARGUAUTRGUAUUUUAGUURGGGUAAUURG GGUUAUAUGAUUURGUGUAAUTGUAGRGXGUGGUUUAGUUUXGGGUTGUAGURGURGU TRGUUUAUAUUUTGUTGURGGGUAUGGGUAAGUUUAGUGGAUUUUAUUURGRGGU UUARGUUGURGRGUUAUGAUUURGRGGGGURGUUTRGRGAGGAURGGUGUGUAUARGT GUAUAUAUGUA |
| 85 | ARGURGUUAGUUUTGAUTGGUUUAGRGGUAGGAAAGGUUAAAUUAAAAAUTTTTTTAUA GUUUAGUGUGRGUUGUAGUTRGGAAAATTAATTGUGGUUAUAGURGUUUTRGAUTRGUU GUTUUUUAGUUTRGURGRGGURGUUTARGGGAXGRGUUURGUURGUGUUUTGGUUUTUU UUUUUTTTGGGUGUTGUUGUTGUTGUTGUAUTGUUGUTGRGAGAGGAGAGGAGGA GGAGGAAGUAGRGGGGGGGGGAGRGGGGGGUGGGGGGGAGAUUAAGAAGUAUAGUU GGGAGRGAG |
| 86 | UTRGUUUUAAUUTGUAUUTUTTGGTUUUUUUUUUAUUUUURGUUUUUUUUURGUUG UUUUUUUUUUUUUUUUTRGUAGUAGUAGUAGUAGUAGUAGUAGUUU AAAGGGGGGAGAGURGGGRGGRGGGRGGRGXGTUURGGAGRGGURGRGGRGAGGU UGGGGAGAUAGRGAUTRGAGGRGGUTAUAGUUAUAATTAATTTTURGAGUAUGGRGU AUAUAGGGUTGUAAAAAAATTTTTGGTTTAATTTTUUTAURGUTGGGUUAATUAGAG UTGGRGGRGT |
| 87 | AGGUAGAAAUAAAAAUUUTTUUUUTAGAGURGGGGTGGUUAGRGGAAUUAUUGAGAAT GAGAURGUGUGGTUGUAATGGGUUGGGGAAAAUGGGAUGUAAUUUUURGGTGTUTUUT UAGGUUUAGAGUUAUUUGAAUAAAAUGAAGUTGRGXGURGGRGGAGUUAGTAAUUAUTGR GRGGUTUURGGUAGGRGGGGGRGGAGUGGGGGGURGUAGAAURGGARGUGUUTGGRGA GGUUAGAGGRGUUAGRGGUGUGUGGGUGGUAGUGURGGGAUGGUGGAGGGGAGGG GUUARGGGGG |
| 88 | UUUUURGUAGUUUUTUUUTUUAGUUAUUURGGRGUTGUUUAUUUAUUAUAURGUUAGRG UUUTGAAUUTRGUUAGGUUARGUURGGUTTUTGRGGUUUUUAUTRGUUUUUGUUTGUR GGGAGURGRGUAGUGAGUTAUTGAUTURGURGGXGRGUAUTUAUUUAUUUAAUAGUUU UGGGUUUGAAAAAUAURGGGGAAAUUUGUAUUUUAUUUUUUUUAAGUUUAUUAGUAAUU AGRGGTUTUAUUUTRGAUGAUUURGUUGAGUUAUUURGGUUAGGGGAGGGGGUUUUA UTUUGUUUT |
| 89 | UUUTGURGAGGUUAUGGUGUUGUUUUUAGUAGUUTUGAGUUUARGRGGAAUAUGAGTR GUGAUAAAUAAGGUUTGUAGUTGRGAGGGGUUTRGGGGUGGGUUUUUGGUUGAGGAAR GURGGGGAAUTGGUGAUGAGGAAGUUUUUTGUXGGGAGUAGGAGUAGRGGAAAUUA UAUTRGGUUAUAUAGAUUURGGRGGGGGAGGGAGGGUAARGUUUAGAAGUUAGAGUTGR GRGAUGUGUUTTUTGGGUUGUUTAGUUUAGGGUUURGAGAUUUGUUGUUTGAGGAGG GGUAGAUGUA |
| 90 | TGUAUTGUUUUUTUUTAGGUAAGUAGGUUTRGGGUUUUTGGGUUGAGUAGUUUAGAAA GGUAUAURGRGUAGUUTGUUTUTGAGRGUUGUUUTUUUTUUUURGURGGGAUTGUGUT GGURGAUGUAGGGUUURGUUGUUUUUGUUUUXGUAGGGGGUUUUUUUAUAGUUATTU UURGGRGUTUUTUAAUUAGAAAUUUAUUURGAGGUUUUUTRGUAAUTGUAAGUUTGUU UAUAURGRGAUUAUGUUURGRGUUGGGGUUAGAGUGGUGAAAUUAGGGUAUUAUAAAUUT RGGUAGGG |
| 91 | GGUUURGARGUUAGUGUUUUURGAGAAGUUURGUAGRGRGUTRGUUUUAGGAGUGRG AGGAGUUAUAGAUGGRGUGURGUUUAGUUAGUURGUAUUTGGUUTGRGGGGU ARGRGGRGGGUGAGUURGGGUTRGAGAGGRGGRGGXGGGUUAGGGAAGGURGGGGGUUR GGRGGGTGUTRGRGGUTGGGGAGTGGGRGGUUUTUUUUTUUAGGUUUTGUUAGGGUURG AAGUUUAGGUUUUAUUTGGUUGGGGUUGRGGUUTUUTTUURGURGUUTUUUURGUUUUAU UAGGUUURGGG |
| 92 | UURGGGAUUGGUTGAGGRGGGGAAGGRGGRGGGAAGGGAUGRGUAUUUUUAGUUAGGUG GGGUUGGGUUTRGGGUUTGGUAGGGUUTGGAGGGGAGAGGRGUUAUAUUUUAGUR |

TABLE 4-continued

Sequences Listed in Table 1

| SEQ ID NO: | Sequence |
|---|---|
|  | GRGGAUAUURGURGGGUUURGGUUTUUUTGGUUXGURGURGUUTUTRGAUURGGGUT<br>UAUURGURGRGTGUUURGUAGGUUAAUUAGGTGARGGGUTGGUTGGARGGUAGRGUU<br>AUAUAUGGUUUUUGUAUUUUUGGAGRGARGRGUUGRGGAGUUUUUGGGGGGAUAGUU<br>GGRGURGGGGUU |
| 93 | GTTTTTRGTTTUUAATGUUUTGGAUUTTTAGAGAGUTUAUAUUUUUUUUAUGGUTRGUA<br>AGUUUUGAAAGAAAGAGUAAGAGAGRGAGRGGGTTGGGTTGGGGUTGGAGUAGURGAG<br>GURGGUUUGGGUURGGGUAGUUAGGUUTGAXGRGGUUURGRGUUUTUUURGGUAGAG<br>AAGUURGGGARGGUUAUGUGRGTGGGUTGRGGGAGUUAGAUUUARGAUUAGUUUAUU<br>TGRGGGUTGRGUUUGAUUUGAGUGGUARGRGGUUUGUUUAAGUGUGURGAGUGUAG<br>UUAGUAUU |
| 94 | GGTAUUGGUTGUAUUGGUAUAUUUGAGGUAGGURGRGUGUUUAUUGAGGUGGGGRGA<br>UAUURGUAGGAUAAAUGGURGUGGAUUGAUUURGUAGUUUAGUAUAUGGURGUU<br>URGGGUUUUTGUGRGGGGAAGGGRGRGGGGGURGGXGUAGGUUUGAUUGUURGGAUUU<br>AGGURGGUUUGGUAUUUAGUUUUAAUUUAAUURGUURGUUUUUUGUUUTTTTT<br>UAAGAUUUGRGAUUAUAAGGAAAGAUGAUGAGUUUUUAAAGGUUAGGGUAUUGGAA<br>ARGAAAAAU |
| 95 | TGTAUUUGGGUUUUUUUAUUUUUUUUUAGUUGGGUUUAUAUUGGGUUGGUUUUA<br>AGUUUUGGGUAUAUGGGAUAGAGAAUUUAAGGAUUUAGAUAUUUGUAAUUUURGGGUT<br>AGUAGGAGGAAAAGTGGUUUUUGGGAUUUXGGAUGGGURGAAUAGUAGUUUGGU<br>AGAGGUUUUUAGGUUUAGAGUUUUUAAGUGGGAGAAGGGGRGGUUUGUUGUAGUURG<br>RGUAUURGUGGUAGUAUUAUAGAGGGAAUAAAAGUAGGGUAAAAUAUUUGAAGAUUU<br>UUARGAAGG |
| 96 | UUTTRGTGGGGAUUUUUAAAUUGUUUAUUUUGUUUUUAUUUUUUGUGGUGUGUUARG<br>GGUGRGRGGGGUGAGUAGGURGUUUUUUUUUAUUUGGAGAAUUGAAAUUGAGG<br>GUUUUGUGRGGAAGUGUGUUGGUUUAUUXGGGUUUUAGAGGAGUUAUUUUUUU<br>UUAUAGUURGGGGAUUGUAAAGUAUUGGAUUUUAAAUUUUAUUUUAUAUGUUUA<br>AGAUUUAAGAGUUAGAUUUAGAUGUGGGUUUAAUUGGGGGAAAGUAGGGGAAUUUA<br>GGGUAUA |
| 97 | UTGUUUGUAGUURGAGGAGUUGAUAAUGUUUUGGAGAUAGUAAUAUGRGTGUUUAUU<br>AGUAUGUUUGUUUGGAGAUGUGUGUGAAGUGUUGGUUGRGGUUUUUGGGUUAUAU<br>URGGAAUURGUAUAAUAUUUUGARGGUAUAUXGTGGUAUAUAGGUGGGUUUUUAUU<br>UUUUUUUAGGAAGAGGGGUURGGGAAGUUUAUUUUUGGUAGAAAUUUAUUUGUA<br>GAGUAAAAUUUAGAGUAUAGGGAGGGAAGUARGARGAUAGUUUUUAUGAUAGGURGTGG<br>GAAGUAGGT |
| 98 | AUUUGUUUUUAARGGUUUGUAUAAAGAGUUAUGRGUGRGUAUUUUUUUUGUGUUUUGGG<br>TTTTGUUUGUAGGUGGGAUUUUGUUAGAGAGUGGAGUUUURGGGUUUUUUUUUUG<br>GGGAGAGGGUGGGGAUUUAUUUGAUGAUUAXGAUGAUGURGRGAAGAUGUUGUARGG<br>GUURGGAUGAGUUUAGAGGGURGUAGGUUAGUAGUUUAGUAGUAUUUUAGGGUA<br>AAUAUGUGGUGAAUARGAUGUUGUGAUGUUUUAGAGUAUUAGUUAGUUUUGGGGUTG<br>UAGGUAG |
| 99 | UUUUUUGGAAGGUGUUAAUUUUUGAGGUUUUAGGGGAAUAAUGAGGAGGAGAAAAAT<br>UUUAGUGUGAAAAUGAUGUUAGRGGAGUUGUUGUUUUUUGUUGUGUUUUAAAA<br>GUUAUUUUUUGUGAGGGUGUGGGUURGXGGGAUUGUUUUUUUUUUTUUUGUUU<br>AUUUUTTUGGURGGGUGAGUUUAUUUAAGAUUUUUAUUGUAUUUUAUAGUUUGGU<br>UUUUAUAUAAAAUGAAGUUAUUUTUGGGUUTUGAAAUAGUUUUUAUUUAAUUUAAA<br>AAGAUUU |
| 100 | GGAUUUUUUGGGUGGAGUGAGAAGUGUUUUAGAGUUUAGAGGGUGAAUUUAUUUGU<br>AUGGAGAUUAAGUGUGAGAGUAUAGUGAGGAGUUUUGAGAUGAGAUUAUUGGUUA<br>AAGAGAUGGGUAAAGAGGAGGAGGGAUAGUUUXGURGGUUUAGUAGUUUUGUAGAG<br>GGGAUGGUUAUAAAGGAUAGAUAGAUAAAGGGAUAAGUAAAUUURGUUGAUAUAUTT<br>TUAUAUUGGAUUUUUUUUUUUUAUUGUUUUUUGGAGGUUAGAAAUUAGUAUUU<br>TUUAGGGGG |
| 101 | RGTRGTAGUUGGGGGURGAGGGUURGUGUGGUAGGGGAUUGGGAUAGGGAGUURGGAGUUGU<br>AGGGRGAGGGUUUAGAUUGGGGUUGGAAGUUAUAGGUUUUUAUUUTRGUUUGGURGAG<br>RGGURGGGAUUURGGGUUUGUAGRGGAUGAAGXGGGRGUUGUUUUGUURGGRGGRGG<br>URGGGGUUUUTGGGGUUUUUURGRGGGRGGUURGGUAGGGRGGUAGUAGUGURGRG<br>GAGAGGARGAURGUUAUURGGUGUAAUUAGGUUUURGRGUUUUGUURGGUUTUTGGG<br>GRGUUUAAGRG |
| 102 | RGUTTGGGRGUUUUAGAGGGURGGGUAGGGGRGRGGGGAUUUGGUUGUAURGGUGGRGG<br>TRGUUUUUURGRGGUAGUUGUUGURGUUUUUGURGAGURGUURGGGGAAAAUUUUAG<br>AAGGUUURGGURGURGURGGGUAGGGUAGRGUUXGUUUUUAUURGUUGRGGGGUURGG<br>AGUUURGGURGUUGGUUAAGRGAGGUGAGAGGGUUGUGGUUUUAGUUUUGAUUGG<br>GUUUUGRGUUUUGRGAUUURGAUUUUUGUUUAGUUUUUUAUUAUARGGAUUUGGUUU<br>UAAUUARGARG |

TABLE 4-continued

Sequences Listed in Table 1

| SEQ ID NO: | Sequence |
|---|---|
| 103 | RGUAGGURGUAGTGARGTRGGRGGGRGUTGUATTAAGGRGAGGGGGUTTUUAGAGUTU AGUUAAUAGUUAGGAGUAGTGAUUAAGURGURGGAGUUGGGGAGAGARGUAURGGGG RGGRGAUTGGGUUAGGAGAUUAGGGAUTGAGGGAXGRGUURGGGAGGGUUAGUAAU AAGURGRGGUURGGGRGRGAUAGRGGRGGUURGRGURGAGURGTUUAGURGURGGUU TAUTGTAGURGUTGRGUUAGGAUATTTTTTTTAAAGUTUTUUAAGUTGUUUUUUTUUT UUURGAUTUUT |
| 104 | AGGAGTRGGGGAGGAGGGGGUAGUTTGGAGAGUTTTAAAAAAAAATGUUTGGRGUA GRGGUTAUAGTAGGURGGRGGUTGGAARGGUTRGGRGRGGAURGURGUTGTRGRGUUR GGGURGRGGUTTGTTGUTGGUUUTUUURGGGRGXGTUUUTUAGTUUUTGGTUTUUTGGU UUAGTRGURGUUURGGTGRGTUTUTUUUUAGTURGGRGGUTTGGTUAUTGUUUTGGU TGTTGGUTGAGUTUTGGAAGUUUUUTRGUUTAATGUAGRGUURGURGARGUAUTGRG GUUTGRG |
| 105 | RGUUUTRGGUUURGUUUUUTGUURGUUUUTUUUTUTRGGGGTURGGGGRGRGAGUTGR GGRGGRGGRGGUUARGGTUATTGGRGURGAGRGGTTURGGUTGAUTGGARGGGGRGGG RGTUURGGGUAGUUTAGRGRGGTAUUTUURGUUUXGRGRGUUUUAGURGGRGAGGGAUA TTGGAUUAGGGTRGGGGTRGRGGURGUTUUAGRGAGGTAAGAGURGGGAAGAURGGG AGAGAUUAUUTUTTUUATUUTGGGGGGGTUUUTGGGGGARGGTUTUUUAURGGTGUTG GGURGRGGRG |
| 106 | RGURGRGGUUUAGUAURGGTGGGAGAURGTUUUUUAGGGAUUUUUUUAGGATGGAAG AGGTGGTUTUTUURGGTUTTUURGGUTUTTAUUTRGUTGGAGRGGURGRGAUUUURGAU UUTGGTUUAATGTUUUTRGURGGUTGGGRGRGXGGGGRGGGAGGTAURGRGUTAGGUT GUURGGGARGUURGUUURGTUUAGTAGURGGAAURGUTRGGRGUUAATGAURGTGGU RGURGURGURGURGUTRGRGUUURGGAUUURGAGAGGGAGGGGRGGGUAGGGGRGG GGURGAGGGRG |
| 107 | RGUUUTURGGUURGGUUTUUTURGURGGUURGGUUURGAGAGGRGUAGUUAGUTUTU RGUUATGTUTGRGGGGAUTUTURGAGGGGGRGGTUAGUAUUUARGGGUGAGURGGGG GTGGUURGURGRGUTUTUTGGUURGUTGAGTUUXGUAGUTUURGUUAUARGGUUTUUR GGARGRGRGUTTUUATUTRGRGAUUURGGGGRGUUTUUTURGAATAAGTATGTGGTGU UTGRGAGGAUUARGGTGGGAGUTGAGUAUAUUUUAUUUURGAGGGGAUAGTGTGTGT ARGGGGARG |
| 108 | RGTUUURGTAUAUAUAUTGTUUUUTRGGGGGTGGGGTAGTGUUAGUTUUUAURGTGG UUUTRGUAGGUAUUAUAUAUTAUTTATTRGGAGGAGGRGUUUURGGGGTRGRGAGATGGAA GRGRGRGTURGGGAGGURGTGUAAGRGGAGUTGXGGGGAUUTAGRGGGUUAGAGAGRGR GGRGGGUUAUUUURGGUTUAGUURGTGGATGUTGAURGUUUUUTRGGAGAGUUUUURGU AGAUATGGRGGAGAGUTGGUTGRGUUTUTRGGGAGURGGGURGGRGGAGGAGGURGGG URGGAGGGRG |
| 109 | RGGGGTGUAGAGGGUAAGAATGGGGGUAGAAAAUUUUUAGGTRGTGGUUUTGGGUUUAG AAAGTTGUUUUAGUUTGRGRGUUUUTTUUUAGUUUUTUAGGGUUUTTUUTUAUUUURGR GGARGGTUUUAUURGGGTGGUAAAGTTAGTGTGXGRGUUTUGGAGUTUUUUUTURGG TUUUTUURGTUURGUURGTUTGUUUUTAGGTRGGUTAUUUUUAAUUUUUURGUUUTGT GUUAUUUTUTUUUUAGUUTTTGGTGGUAUTGUTUTUUTUUURGRGGGGUTRGGGUUTG GUTURGARGA |
| 110 | TRGTRGGAGUUAGGUURGAGUUURGRGGGGAGGAGAGUAGTGUUAUUAAAGGUTGGG GAGAGGGTGGUAUAGGRGGAGGGGTTGGGGGGTAGURGAUUAGGGGUUAGARGGGRG GGARGGGAGGGAURGGAGGGGGAGUTUUAAGGRGUXGUAUAUTAAUTTTGUUAUURG GATGGGAURGTURGRGGGGTGAGGAAGGAUUUTGAGGGGUTGGGAAGGGGRGRGUAG GUTGGGGUAAUTTUTGGGUUUAGGAUUARGAUUTGGGGGTTTTUTGUUUUUATTUTTA UUTUTUGUAUUURG |
| 111 | GGTAATTTRGGUUUUUTGAGUTTGGUUTAGTTTTTURGRGAAGTGUARGGGGGURGTTTT AGGATAUUUAGUTUUUAUUTGGAGUTUUUAGAGUTUURGGGGAUUUUUTTGTURGUURG TUTUUTAGGGUUTGGUAUTUUUTGGUUUXGUAGUUXGGGGAUUTUUAUUTUUUUAGG RGGUAGUUAUAGGUUURGURGGGUURGTURGAGGUTGRGGURGURGAAGTRGGGGTU TUAGGGRGUAGGGAGUAAUUAGGURGRGGGGAGGGAGGURGGRGURGGRGRGGAAT TTUTTTATU |
| 112 | GATAAAGAAATTURGRGURGGRGURGGUUTUUUTUUURGRGGUUTGGTTGUTUUUTGA RGUUUTGAGAUUURGAUTTGGRGGURGUAGAUUTRGGARGGGUURGGRGGGAUUTGT GGUTGURGUUTGGGGAAGGTGGAGGTUUUXGGGUTGXGGGGUUAGGGAGTGUUAGGU UUTAGGAGARGGGRGGAUAAGGGGUUUURGGGAGUTUTGGAGUTUUAGGTGGGAGUT GGGTATUUTAAAARGGUUUURGTGUAUTTRGRGGAAAAAAUTAAGUUAAGUTAGGGGG URGAAATTAUU |
| 113 | AGATTGGGAATUTGGAGGGTAAAATGURGGGTUUUTTUURGAGUUUUTAGAGUURGAA RGTTGTRGAATRGGTUAATGTUUAUUURGUTGUTAUUTUTGTUUUAGUAGRGUGRGGG UUAGRGRGUUUTUURGURGRGTUTGRGGAGUTGRGGGAAAAGUAGGTUUURGGGGGGT |

TABLE 4-continued

Sequences Listed in Table 1

| SEQ ID NO: | Sequence |
|---|---|
|  | ATRGAGTGTUUAGGGATATUUARGUAGAUAUUUTTGTAUTTGUAAATAUAAAGAAAUA<br>UAUAGGAUAGAGAUAGGUTRGRGUUAGGGUTRGATUTUUTRGGGGUTUAGGGTTGGA<br>GGURGTAUA |
| 114 | TGTARGGUUTUUAAUUUTGAGUUURGAGGAGATRGAGUUUTGGRGRGAGUUTGATUTU<br>TGTUUTGTGTGTTTUTTTGTATTTGUAAGTAUAAGGATGTUTGRGTGGATATUUUTGGAU<br>AUTRGATAUUUUURGGGGAUUTGUTTTUURGUAGUTURGUAGARGRGGRGGGAGGGR<br>GRGUTGGUUURGGRGUTGUTGGGAUAGAGGTGAGUAGRGGGGTGGAUATTGAURGATT<br>RGAUAARGTTRGGGUTUTAAGGGUTRGGGAAGGGAUURGGUATTTTAUUUTUUAGATT<br>UUUAATUT |
| 115 | AGGGUUTAGRGGRGGUAUURGUAUUUTUTTUTTATGGUAUAAGUTGAAGGRGGRGG<br>URGRGGUAGGGAAGGTGTAGGGGTGRGGGAAGAGUURGURGUAGUURGGGAAUTUTG<br>UAGGARGUUUURGAARGAGUUUTTGUTGGGUAUXGGGATGAUTGGGTAGUTGRGRGGG<br>UUTTTGGUUUUTGUUURGGUAUURGUUUURGRGUURGRGUUUARGUUUARGURGGUUA<br>UAUAGUUAUUUUUAGRGURGUUUUUAUUAGTUUURGRGURGUURGAAGUAGUAGUUA<br>UAGAGAGGUTG |
| 116 | UAGUUTUTUTGTGGUTGUTGUTTRGGGRGGRGRGGGGAUTGGTGGGGRGGRGUTGGG<br>GGTGGUTGTGTGGURGGRGTGGGRGTGGGRGRGGGRGRGGGGRGGGTGURGGGGUAG<br>GGGGUUUAAAGGGUURGRGUAGUTAUUUUAGTUATUUXGGTGUUUAGUAAGGGUTRGTTRGG<br>GGGRGTUUTGUAGAAGTTUURGGGUTGRGGRGGGUTUTTUURGUAUUUUTAUAUUTTU<br>UUTGURGRGGURGURGUUTTAGUTTGTGUUATAAGAAAGAGGATGRGGGTGURGURG<br>UTGAGGUUUT |
| 117 | AUTARGGTURGURGGGUUARGAUAAAATGUUAGUUUUAAUTTRGARGRGUAUUAUAU<br>TGUUATGUTGAUURGRGGTGAGUAAUAUUTGTUURGRGGUUTGGGUAUUUUAUUTGRG<br>GUUATGATGTRGUAUUTGAARGGUUTGUAUUAUUXGGGUUAUAUTUAGTUTUARGGGU<br>RGGTGUTGGUAUUUAGTRGRGAGRGGUUAUUUTRGTUUTUATRGGGUTRGUAGGTGGU<br>UARGTRGGGUUAGUTGGAAGAAAUAAAUAUUAAAGAGGTGGUUUAGRGUAUAUAGR<br>GGAGUTGAAGU |
| 118 | GUTUAGUTURGUTGUGATGRGUTGGGUUAUUTUTTTGGTGTTGATTTUTTUUAGUTGGU<br>URGARGTGGUUAUUTGRGAGUURGATGAGGARGAGGGTGGURGUTRGRGAUTGGGTGU<br>UAGUAURGGUURGTGAGAUTGAGTGTGGUUXGGGTGGTGUAGGURGTTUAGGTGRGAU<br>AUAUGGURGUAGGTGGGGTGUUUAGGURGRGGGAUAGGTGTTGUUAURGRGGGTUA<br>GUATGGUAGTGTGGTGRGRGTRGAAGTTGGGGUTGAGUATTTTGTRGTGGUURGGRGGA<br>URGTAGT |
| 119 | TGGGGTUAGTAGAUAGTUTUTTUAGAUAUGATGUAGAAGUTGGGAUTGGTAAGTAG<br>GTATTATGTGUTRGGAGRGUTAGGGGAUAGGAGUAAATGGAGAAGAAAAGRGGAGGUT<br>TTUTURGUURGGAGTATRGATRGGAAUTUUURGUXGGTARGURGUAGAGGGUUUTRGUR<br>GTTGGGUUURGGGGGTTTAAUAAGUUUAGURGUTURGUAGGRGGUTRGGURGGAUTUT<br>UAGAURGGTGUUTGGAAGAUAURGTUUUTGUUUUUUTUURGUUAAAUUTGUUTUTTUT<br>UTTTUTUTUA |
| 120 | TGAGAGAAAGAGAAGAGGUAGGTTTGGRGGGAGGGGGUAGGGARGGTGTUTTUUAGG<br>UAURGGTUTGAGAGTURGGURGAGURGUUTGRGGAGRGGUTGGGUUTGTTAAAUUUUR<br>GGGGUUUAARGGRGAGGGUUUTUTGRGGRGTAUXGGRGGGGATTURGATRGATAUTUR<br>GGGRGGAGAAAGUUTURGUTTTUTTUTUUATTTGUTUUTGTUUUUTAGRGUTURGAGU<br>AUAUAATAUUTAUUAGTUUUAGUTTUTGUATUAGTGTUTGAAGAGAUTGATUTAU<br>TGAUUUUA |
| 121 | AGUTURGAGUUUARGUTGUAGUUAGAUURGGATGAGTURGTUUTURGUUURGGGRGGG<br>UUTRGUTUTRGUTGGUUUTUAGRGURGRGUAGUUAGUAGUAUUUUAURGTGARGUT<br>RGUAUAUAUUURGGGRGURGGURGUUAUUATUXGRGURGURGURGTUAGGAUUUTUUT<br>UURGGGUATRGTRGURGURGRGGGGTRGGGAGGARGRGGRGRGRGGGAGGGRGGUR<br>GUAGGGRGAGUUURGGGARGUUURGAGURGGGURGGGGURGGGGAGAGGGRGUAGR<br>GAGGTGGGGGU |
| 122 | GUUUUAUUTRGUTGRGUUUTUTUUURGGUUURGGUUURGGUTRGGGRGTUURGGGG<br>UTRGUUUTGRGAURGURGUUTUURGRGURGRGTUUTUURGAUUURGRGGRGGRGAR<br>GATGUURGGGAGGAGGGTUUTGARGGRGGRGGRGXGGATGGTGGRGGURGGRGUURGG<br>GTGTGATGRGAGRGTUARGGTGGGGATGUTGUTGGUTGRGRGGRGUTGAGGGUUAGRG<br>AGAGRGAGAGUURGUURGGGGRGGAGGARGGAUTUATURGGATUTGGUTGUAGRGTGG<br>GUTRGGAGUT |
| 123 | AGUUUTGGRGTUTTTUTRGGGGUUAGAGUUTTGUUTUTAAATGGTUTTTGUTTGUAGA<br>RGATUTGUTGTGUAGAUAUGAAURGTRGURGUAGTGUUAGAUAGAUTUTTUATURGG<br>AURGGURGTUUUAUTGGGTUUUUTAGGAAAGXUAGAAGURGGGGAUUUUAAAUURG<br>RGTUUAGUTUUTUUUAUURGUUUTTUTRGGAGURGRGUAUUTGGTAAUTTGRGTGTGAA<br>GAAUUARGGURGTGUTTGUUAGGAAAUTGRGGGGAGUAGUUUUTGTGGUTUUTAUAUAT<br>GRGTAAUAT |

TABLE 4-continued

Sequences Listed in Table 1

| SEQ ID NO: | Sequence |
|---|---|
| 124 | ATGTTARGUATATGTGAGAUUAUAAAGGUTGUTUUURGUAGTTTUUTGGUAAUARGGU<br>RGTGAGTTUTTUAUARGUAAGTTAUUAAGTGRGRGGUTURGAGAAGGGRGGGTGGGAG<br>GAGUTGGARGRGGTTTGGGGTUUURGGUTTUTGXGUTTTUUTGAGGGGAUUUAGTGGG<br>ARGGURGGTURGGATGAAGAGTUTGTUTGGUAUTGRGGRGARGGTTUATGATUTGUAUA<br>GUAGATRGTUTGUAAAUAAAGAUUATTTAGAGGUAAAGUTUTGGUUURGAGAAAGARG<br>UUAGGGGUT |
| 125 | GUTTGAAUAGTTTTTTUUAATGTTRGATATTTAUATTTTTTGTUAUTTTTATTTTAGTUUT<br>URGRGAAGGAGUUTUTUAAATATTUURGGAGUAUAGGUTAATTTAGAARGTGTTATUUT<br>GAUAAGGRGGUUUAGUUAGGGAGGAGARGUXGGGGTURGRGURGRGGGRGGGRGUT<br>TUUURGGAUURGGGGGAGGRGGGARGUAGGRGAAGGURGUUURGGGAGAGRGGGGTU<br>URGGGAGAGRGGGGTUURGGUTGTGGGGGARGRGGGURGAGGUTGTRGRGAAGURGUT<br>GARGGURG |
| 126 | RGGURGTUAGRGGUTTRGRGAUAGUUTRGGUURGRGTUUUUUAUAGURGGGAUUURGU<br>TUTUURGGGAUUURGUTUTUURGGGGRGGUUTTRGUUTGRGTUURGUUTUUUURGGGT<br>URGGGGAAGRGUUURGUUURGRGGRGGAUUUXGGRGTUTUUTUUUTGGUTGGGURGU<br>UTTGTUAGGATAAUARGTTUTAAATTAGUUTGTGUTURGGGAATATTTGAGAGGUTUUT<br>TRGRGGAGGAUTAAAATAAAAGTGAUAAAAAATGTAAATATRGAAUATTGGAAAAAAU<br>TGTTUAAGU |
| 127 | UUTTRGGGGAUUAGAURGRGUTUUUTAGATGGUTGGGGAGGGAGUAGAUTURGGGTG<br>AAGGUTGGGGAGGTAURGGGATGURGAGTARGUUAGAGUAGGRGGGGATGGGTTUR<br>GGUTTUUTGURGUUTRGGUATUTRGUTTTGUAUXGGGUAAAGAAGGGGUUARGAURGG<br>RGAAGAGRGRGTGAGAUAUAGGGAUURGRGATUUAGGGGUAGGAAUUURGUUUUUT<br>UURGGAAAUUTUURGGGUUUTGAGTRGTGUURGGRGUTUUUUAUUUAUUUAUUUU<br>RGURGUUUUTGU |
| 128 | GUAGGGGRGGRGGGGTGGGGTGGGGTGGGGAGRGURGGGUARGAUUAGGGUURGG<br>GAGGTTTURGGGAGGGGGRGGGGTTUUTGUUUUTGGATRGRGGGTUUUTGTGTUTUUAR<br>GRGUTUTTRGURGGTRGTGGUUUUTTUTTTGUUXGGTGUAAAGRGAGATGURGAGGRGG<br>UAGGAAGURGGAAUUUATUUUURGUUTGUTUTGGRGTAUTRGGUATUURGGTAUUTUU<br>UUUAGUUTTUAUURGGAGTUTGUTUUUTUUUUAGUUATUTGAGGGAGRGRGGTUTGGT<br>UUURGAAGG |
| 129 | GGATGGGUURGGRGRGGUUUAGUUUUTGUURGGUURGURGGGUAGAGAUTGAAURGR<br>GGATUUUUAURGTUUTGTGGARGAURGGAUAGAGAGGUATGAURGATRGUUAGUA<br>GUUTUURGGTGGGAURGRGTUTUUTGUAUAUUUXGRGUAGRGUUUUURGURGGAGURG<br>UAURGGGUAAGURGGRGAGGGAGRGGGUTGATTGGRGGURGURGGRGGUUAGGGGA<br>GGGGRGURGRGRGGGGUUATGGUAGGUTRGGAGGRGTUUTAGUURGAGURGGGAGURG<br>ATURGAGUUUA |
| 130 | TGGGUTRGGATRGGUTURGGUTRGGGUTAGGARGUUTURGAGUUTGUUATGGUUURGR<br>GRGGRGUUUUTUUUTGGURGURGGRGGURGUUAATUAGUUURGUTUUUTRGURGGU<br>TTGUURGGTGRGGUTURGGRGGGGGGRGUTGRGXGGGGTGTGUAGGAGARGRGGTUUU<br>AURGGGAGGUTGUGRGATRGGTUAGTGUUTUTUTUTGTURGGTRGTUUAUAGGARGG<br>TGGGGATURGRGGTTUAGTUTUTGUURGGRGGGURGGGUAGGGGUTGGGURGRGURGG<br>GAUUUATUU |
| 131 | AGAAGAGGAAAAURGAGURGGRGGUTGRGGURGGGUATRGTATGGRGUTAGAGAAUTT<br>RGGRGGRGAGRGGGAUUTGRGUUTGGGURGURGUUTUUURGUURGRGGTUURGGGAUR<br>GTTAUTTTGAAAAGGAGTUURGAGGUUTGGRGUUXGGRGRGRGATRGGGAUUURGRGT<br>UUAGUTURGGGGAUURGGURGGRGUUUUUAUURGRGAGRGGUURGRGAGUUAUUT<br>UAGGUUURGGGAAAUTTUAAGAGGGTUTGGGGGTGGGGGAGTAAAAAGGGGAGG<br>GGGTAGGUTGGG |
| 132 | UUUAGUUTAUUUUTUUUUTTTTAUTUUUUUUAUUUUUAGAUUUTUTTGAAAGTTT<br>UURGGGGUUTGAGAGTGGUTRGRGGGURGUTRGRGGGTGGGGGRGURGGURGGGTUU<br>URGGAGUTGGARGRGGGGTUURGATRGRGUXGGGRGUUAGGGUUTRGGGAUTUUTTT<br>TUAAAGTAARGGTUURGGGAURGRGGRGGGGAGGRGGRGGUUUAGGRGUAGGTUURG<br>UTRGURGURGAAGTTUTUTAGRGUUATARGATGUURGGURGUAGURGURGGUTRGGTTT<br>TUUTUTTUT |
| 133 | TTUTUUUTGAAAUTTGTTTGAAAAUTUUAAGTGAAAAURGRGARGATUTGUAUAUTUAAA<br>AGUAAGTGUUAAGTAAGTGUUUTGRGGTGGUUTRGRGRGUUUUGGGGTGAGRGRGUA<br>AAGURGGGAGRGAGGTGURGRGAGUTGRGRGUXGUUURGGGURGGUUTRGRGTGTGGG<br>RGGUTGGGRGGUTGGGRGGRGGGAGGARGGUUTRGRGGGUURGGGAUTGUURGGUT<br>GGUTGUTRGUAUAAUTTTTTTTTTUUURGTUTGTGAUTTTTRGGGUUAGGTGAAGT<br>GTTTGGG |
| 134 | UUUAAAUAUTTUAUUTGGUURGAAAAGTAGUAGARGGGGAAAAAAAAAAAAGTTGTG<br>RGAGUAGUUAGURGGGUAGTUURGGAGUURGRGGAGGURGTUUTUURGURGUUUAGU<br>RGUUUAGURGUUUAUARGRGAGGURGGUURGGGXGGRGRGUAGUTRGRGGUAUUTR<br>GUUURGGUTTTGRGRGUTAUUURGGGGRGRGURGAGGUUAURGUAGGGUAUTTAUT |

TABLE 4-continued

Sequences Listed in Table 1

| SEQ ID NO: | Sequence |
|---|---|
|  | TGGUAUTTGUTTTTGAGTGTGUAGATRGTRGRGGTTTTUAUTTGGGTTTTUAAAUAAGTT<br>TUAGGGAGAA |
| 135 | ATTURGGGAGATURGRGUUUAGGUURGRGRGUTRGGGGURGUTUTGGUUTUAGAGURG<br>UTGUURGAUUUAGGAAURGGUAURGRGTRGUUAAGGGUAGUUAUUGGRGGURGUAGAR<br>GGAGGAGGARGGRGTTGGURGGGARGRGGAUAGXGUAGGGUAGRGGRGGGGRGRGG<br>GURGGGGUUARGGGRGUAGGGGURGGAGURGUUGUAGURGUAAGURGUUGUARGTGG<br>AUUUAAGGAGUURGGUUUGGGARGAUUGGAUUAURGRGUURGUUGGAUUARGAGGRGUA<br>UUAUUGRGAGGG |
| 136 | UUUTRGUAGTGGUTARGUUTRGUUAGTUUAGRGGRGRGATGAUUAGTRGUUUUAGURGA<br>GUUUUUGAAGUUUAARGUUGUAAARGGUUUGRGGUUGUAGRGGUTURGGUUUUGRGUUR<br>GTGGUUUURGGUURGRGUUUURGUURUGGUUUUTGXGUUGUTURGRGUUURGGUUAARGUUR<br>GUUUUUUTURGUUUGRGGURGUUAATGAUUGUUUUTGGRGARGRGGUURGGUUUUUGG<br>GTRGGGUAGRGGUUUGAGGUUAGAGRGGUUUGAGRGRGRGGGUUUGGGRGRGGAUU<br>TUURGGAAT |
| 137 | GGGGURGUAGGGGGUUGGAAGGAAGUAGGUAGUGGUAGAGAGRGRGAAUAAAGUUU<br>TUUTURGGAGUUUURGUUAUUUUUTRGGUGAUUUUAGGUURGUUUURGUTGAGURGRGGGGU<br>TUURGGGUUTRGUUUURGAGUAGGURGUAUURGUUXGGTGGGRGUARGUUAGGUUURG<br>RGGURGUUURGGGUUAGUUGUUUUUUTRGGUUUUURGUUAGGURGAGUURGRGGRGGUUUR<br>GAAGGRGRGAGGGAUAGRGGURGGRGGUGGAGUUUUAUUUAGUAGGGAGAGUUUAU<br>AGAGRGAGGUTG |
| 138 | UAGUUUGUTUTGUGGGUUURGUGUUUGAGUGAGGGUUUAURGUUGGGURGUUGUUGUUU<br>UTRGRGUUTRGGGUURGGURGRGGGGUUGGGUUUTGRGGGGAUUGAGGGGAGUAUUGGU<br>URGGGRGGURGRGGGAGGUUTGARGUGRGUUUUAUGGGRGUTGRGGUUUTGUUTGGAGGR<br>GAGGUUUGGGAGUUUURGRGGUUUAGRGGGGRGGGUUUGGGUUAURGAGGGGUGARG<br>GGGUURGGAGAGGGUUTTGTTRGRGUTUUTRGUUAUAUTGRGUAUTTUUTTTUUAGUUUU<br>UTGRGGUUUU |
| 139 | URGUTGUUUURGGAUUUTUTUTGUUTGUAUAAUTRGTRGUTUTTRGRGUTGUAGAAUUT<br>GUAGUUUTGGGURGAGGAUAAUAAAGTGGUUUAGTGTURGGGUTRGUUTRGGTGGTG<br>TGAGRGARGUUURGTURGATRGGRGTGGAGRGUXGGGUUUUGGGAGRGGUGGAGRGRGRGG<br>UTGUUTGRGUUAUTGGUUAGTGGUAGURGGRGRGUGAGGAGRGGUAGGUUTGAGG<br>UTGTRGTRGAGGGUUUUUUAUUAUGRGURGGUUUAAGUUAGRGTTGRGUAGATGU<br>ARGGUUAGU |
| 140 | GUTGGURGTGUAUTUTGRGUAARGUTGGUUGGGAGURGGUURGGUGGUGGAGGAGUUUT<br>RGARGAUAGUUAAGGUUGUGUUGUUUUUAAARGRGUUURGGUTGUUAUAUAGAUUAUGGA<br>RGUAGGUAGUUGRGRGUUUAURGUUURGGGUUUXGGRGUUAARGURGAUUGGARGGG<br>RGTRGUUAUAUUUAURGAGGRGAGUURGGAUUAUUGAAGUUUAUUUTGUUGUUUUTRGGUU<br>UAGGGUTGUAGGUUUTGUAGRGRGAAGAGRGARGAGUUGUUGUAGGUAGAGAGGGUURG<br>GGGGUAGRGG |
| 141 | AUUAUUGUUAUAGUAAUAUAUAAUUTRGGGUUUUARGUAGAUUUAAUUURGAGAGGGUAAUU<br>GUUUUUUUGUUTGGGRGGUUARGUUUUUURGRGGGGGUGUUGUAGUUUURGGGUUUTT<br>GUAGUUURGGGARGGRGRGRGGRGGRGGAGGGUXGRGGGGGUUUUAAGRGUUAGUUTGG<br>UUURGGRGUAGAUGRGUUGUUUURGGUURGUAGUUAGURGURGRGUGUGUUGUAGGAR<br>GAUTRGGAAARGRGUGUGUGGGGAGAUGGGUGUUAGUGUGUGUUTGUUUAUUAUUAAAA<br>UUUUAGUTRGU |
| 142 | GRGAUTGGGUUUUTGGAUAAUTGGAUAAGGRGAUAUUGGUAUUUAUATUUUUUAUAUARGR<br>GUUTURGAUTRGUUUTUUUGAUAAUAUAUUARGRGGRGGUUTGGGUUGRGGURGGGGUAGRGUAUU<br>TGRGUURGGGGUUAGGUUTGGRGUUUTGGGGUUUURGXGGUUUUTURGUURGURGRGURGURGUUU<br>RGGAGUTGUAAGGGUUURGGGGGGUUGUAGGUAGUUUURGRGGGGGAGRGUTAGURGUUUAA<br>GUAAGGGAAUAAUUGUUUUUUTRGGGAUUAAGUUUTAARGUGGGUURGAAUTGUGUGUUAAUTA<br>TGAUAAUGGT |
| 143 | RGRGUURGUUTUUTGGAUUAUUTUAUUUUUTTUAAGTUAAUTGGUUUAAURGRGUUUUUT<br>GTTUUUUAUUURGUAUAAAUTTGGGGUUTAAAGGUAUUAGGAUUTGGUAUUUURGGGA<br>TGUUAAUTGTUTUUAGGATGTGUUUGGUUUXGATGUUUUAAGUTAAGUUUURGGGAU<br>AGGUTGGGAAUUTUTUUUTAGUAGUUUUTGUUUUTGGUUUUTAGGGUUUURGUAGGUUTT<br>GGGGTGGUAGTGGUUTTGUUUUAUGUUAUUUUUAGAGGGUUTRGGGAGGUAGAUGGUUUTTT<br>GTUTAGGAA |
| 144 | TTUUTAGAUAAAAUUAUTUTGUUTUURGAGGGUUUTGTGGGAUGAUAUGGGAUAAGGUUAU<br>TGUUAUUUUAAGGUUTGRGGGGUUUUUTAGGGAUUAGGGUAGGGGUGUAGGGAGAGG<br>TTUUUAGUUTGTURGGGGUUTAGUUTGGGGUAUXGGGAGUUAGGAUAUAUUUTGGAAG<br>AUAGGUGGUAUUURGGGGAUGUUUAGAUUUTGGTGUUUUTUAAGUUUUUAAAGUUGUGARG<br>GGGUGGGAAUAGAAAARGRGGGTGGAGUUAGTGAUUGAAGGAGUGAAAUGGUUUAGGG<br>AGGRGGARGRG |
| 145 | UTTUUTTTGTUAUAUUUURGUGAAAUUUUUAUUUAGUAGGUGGARGGAGUUURGRGAURG<br>GGUAGAGUURGGGUTRGUURGAGGAUAGGAGGAGGAGRGGGAGUURGRGRGUUURGG |

TABLE 4-continued

Sequences Listed in Table 1

| SEQ ID NO: | Sequence |
|---|---|
| | GAGAGRGUUURGAGTGUAGGTUUURGUUURGUUXGGRGAGUUURGUTGGAGRGAGUU<br>UAGRGRGURGGGGUTGGGGGGRGGUUARGAUUUUUUTGAAGGGGGTGGUUARGGAG<br>RGUAUUURGAGAAGRGAGUUUUUTUUUUAGAGRGUTGUTUUTGRGGUTGUTGUTGUT<br>GUTGGTGAUUAA |
| 146 | TTGGTUAUUAGUAGUAGUAGRGUAGGAGUAGRGUTUTGGGGAGGGGGGUTRGUT<br>TUTRGGGGTGRGUTURGTGGUUAUUUUUTTUAGGGGGGGTRGTGGURGUUUUUUAGUU<br>URGGRGRGUTGGGUTRGUTUUAGRGGGGUTRGUXGGGRGGGGRGGGGAUUTGUAUTRG<br>GGGRGUTUTUURGGGARGRGRGGGUTUURGUTUUTUUTGUUTRGGGRGAGUURG<br>GAUTUTGUURGGTRGRGGGGUTURGTUUAUUTGUTAAGTGAAGGTTUUARGGGAGATA<br>AUAAAGAAAG |
| 147 | GUUAGRGRGGGURGURGGRGATGARGGURGRGAAGUAGGAGURGUAGUUUAUUURGG<br>GGGUUAGGGRGAGUUAGGRGUAGURGGRGGAUUAGGTGAGAGTRGGUAGURGRGGUU<br>AGGUUUUUURGGGAGGGGTGGUUUAGTGRGRGUTUXGUURGUUUUURGUUUUUAGG<br>UTGGGUTUURGRGUUTUUUTUTTUAUUUUUUURGUUURGUUUUAGTTUUAGGUTU<br>TUUTGUUTUTUUARGGAUTUTGRGGGAAGTTAGAGUUTGUTGRGTGRGUTURGGGGUURG<br>GRGAGAGGATG |
| 148 | UATUUTUTRGURGGGUUURGGAGRGUARGUAGAGGGUTUTAAUTTUURGUAGAGTURGT<br>GGAGAAGUAGGAGAGUUTGGAAUTGGGGRGGGGRGGGGGAGGGTGAGAAGAGGGAGG<br>RGRGGGGAGUUUAGUUTGGGAAGRGGGAGGRGGGXGGAGRGRGUAUTGGAGUUAUUUU<br>TUURGGGAGGGUUTGGURGRGGUTGURGAUTUTUAUUTGGTURGURGGUTGRGUUTGG<br>UTRGUUUTGGUUUURGGGGTGGGUTGRGGUUTGUTTRGRGGURGTUATRGURGGRG<br>GUURGRGUTGGU |
| 149 | GGUTGAAGGTGUUURGGGGAAUUURGGRGGGRGGUUUAURGAGGGAGGGAGAGGRGG<br>URGGGAUUAAGGAATGGGGUUTUTTGGTTUUUUAUUAARGUARGUTGAAGAAAUTGU<br>TGRGUTUUTGARGGURGUUUAURGGGTTRGAGUUUXGTUUTUUTATAGURGGGGRGUTR<br>GUTGGUUAAAGRGAUURGAGUAGGRGAATGAUUUTTAGGRGGARGGGGTUTTUUUTUT<br>GUTUUTUTTGTUTUTTTTGAGGAGARGGGGTGTGTGTTTGTGAGGTGGGGATGGGGGAAGAG<br>TGTUUUAG |
| 150 | UTGGGAUAUTUTTUUUUUAUUUUAUUUAUAAAUAUAUAUURGTUTUUTAAAAGAA<br>AUAAGAAAGUAGAGGGAAAAUUURGTURGUUTAAAGGTUATTRGUUTGUTRGGGTRGU<br>TTTGGUUAGRGAGRGUUURGGGUUATAGGAGGAXGGGGUTRGAAUURGGTGAGRGGURG<br>TUAGGAGRGUAGUAGAUUTUUTUAGRGTGRGUUAATGGGGAAUUAAGAGGUUUUAUTU<br>UTTGGUUURGURGUUUTUUUTUUUTRGGTGGGURGUUURGURGGGGUTUUURGGGGU<br>AUUUTUAGUU |
| 151 | GRGAGUUGUAAAUUUAGAGAAAGGUAUUTGTUUUUAGUAAAAARGUUTGGAGAGGAUR<br>GTGUARGUTGTGUTGUUUURGUUURGAGARGRGURGGGURGURGGGGTUAURGGTTTTU<br>RGAAAGGGAUURGGTUAGAGAUAAAGTGUUTTRGUXGTURGGATAGGTTGGTTTTAUTTT<br>GUAATAAAUAGUUUUUTAATGGGAUURGGGRGURGGGRGGAGAGUTRGGUURGGGGRGR<br>GGUUTTTGURGUUTGGUTUTGRGGGURGUUURGURGGGRGUUAGGTTTTGGGGGTGG<br>UURGGUUURG |
| 152 | RGGGGURGGGUUAUUUUUAAAAUUTGGRGUURGGRGGGGRGGUURGUAGAGUUAGG<br>RGGUAAAGGURGRGUUURGGGURGAGUUTUTRGUURGGRGUURGGTUUUAUTAGGGGU<br>TGTTTATTGUAAAGTAAAAUUAAUUTATRGUAGXGGRGAAGGUAUUTGTUTUTGRGG<br>GTUUUTTTRGGAAAAURGGTGAUURGGRGGUURGGRGRGTUTRGGGRGGGGGUAGUA<br>UAGRGTGUARGGTUUTUTUUAAGRGTTTTGUTGGGGAUAAGTGUUTTTUTUTGAGGTTT<br>AUAAUTRGU |
| 153 | TTGRGGAGTURGURGRGGGUUTRGGUTUURGUUURGGRGUURGGUUTGGUUUUAURGURG<br>UTUAUTRGGTURGUATRGURGUUAUUTURGGAGUTGGTGGGGAGUURGGRGAGGGAGG<br>GUUTGGAAGGGGUUUTGGGRGURGAGUUUUURGUXGGRGURGAUAURGUUTGUUAGG<br>AGUAGURGGUUTGUTRGAGGTGAUTGUARGURGRGGTTUTGGRGRGGUUTUTUAUU<br>AAUATGAGRGGGUTUTGRGTURGAGAGTGAGRGUAGURGGGUAGRGUUUAGTGGATT<br>AUAGUAGARGU |
| 154 | GRGTUTGUTGTAAUUUAUTAGGRGUTGUURGGUTGRGUTUAUTUTRGGARGUAGAGAU<br>URGUUUATGUUGGUGAAGAAGURGRGUUAGAAURGRGRGGUTGUAGTUAUUTRGAGUA<br>GGURGGUTGUTUUTGGUAGGRGGTGTRGGRGUXGGRGGGGAUTRGGRGUUUAGGGUU<br>UUTTUUAGGUUUTUUUTRGURGGGUTUUUUAUUAGUTURGGAGGTGGRGGRGATGRGG<br>AURGAGTGAGRGGRGGTGGGGUUAGGURGGGRGURGGGRGGGAGURGAGGURGRGGR<br>GGAUTURGUAA |
| 155 | TAGGAGGUURGUTUTGUAUUTUUTTAUTGTGGARGGGUUUTUTGAGUTUTGAGGUUTG<br>GRGGGAGAGRGRGTGUAGUTRGAGUTUUTUTTUUUAUUUAGUUUURGUUUUAUUTG<br>GTRGAUUTTURGUAGUUTAGUUGGUUTTGUXGRGUTRGTUUTTGUAUAGGTGGATUT<br>RGRGUAUUURGGGUUTGATUUAGUTRGURGUARGUUUAGGUTGUAUUGGTTAURGG<br>TGUUAUUAUTGGURGGGUURGGGGUURGAGAURGUTGTUTGUAGAUAUUAGGGGGU<br>AGGGGGTUA |

TABLE 4-continued

Sequences Listed in Table 1

| SEQ ID NO: | Sequence |
|---|---|
| 156 | TGAUUUUUTGUUUUUTGGTGTUTGUAGAUAGRGGTUTRGGGUUURGGGUURGGUUAGA TGGTGGUAURGGTAAURGGGTAUAGUUTGGGRGTGRGGRGAGUTGAGAUAAGUURGG GGTGRGRGAGAUUUAUUTGTGUAAGGARGAGRGXGGUAAGAURGGGUTGAGGUTGRGG AAGGTRGAUUAGGTAGGGRGRGGGGGUTGGGTGGGAAGAGGAGUTRGAGUTGUARGRG UTUTUURGUUAGGUUTAGAGUUAGAGGGUURGTUUAUAGTAAGGAAGGTGUAGAGR GGGUUTUUTA |
| 157 | UUTGTURGRGUTUUUAGUUUUUARGUAGUUAGAUAUURGRGGGUGUGAGAUGAAGAG TGAAGUAUUAGGAGAGAUAGGAAAUAGRGRGGGUUTRGGGGAUURGAGGGRGRGGA AGUTRGGGGGURGGGGTRGAGUAUAGAUUGGGAGGXGUAGRGUTGGGRGUARGUUUR GTRGGUURGGRGGUUUUTAATGAGGRGRGUTGUGRGUAGAUTGUAAGAGUAGUATGA GUARGGUURGGRGGUUUUUAGGGUUURGRGGGUGGRGUUAUUURGGAGRGRGGTG UURGGAAUUAUT |
| 158 | AGTGATUURGGGUAURGRGUUTRGGGGTGGRGUURGAUURGRGGGGUUUTGGGGGURGU RGGAGURGTGUUAUGUTGUUUTAGUAGUTGRGUAUAGRGGUUTAUUAGGGGURGG URGGGGURGARGGGGARGTGRGUUUAGRGUTGXGUUTUUUAAUTGTGUTRGAUUURGG UUUUURGAGUUURGRGUUTRGGGUUURGAGGGUURGRGUGUUTUUUGUTUUUTGGG TGAUUUAUUTUUUAUUUAGAUUURGRGGGUGUUGGUGRGUGGGGGUUGGGAGRGR GGAUAGG |
| 159 | UAUUUUUURGGAAAAGUAUAAUAGUUUTTAGAGRAGGGUUUUUAUUUUUAARGRG UUUUAGUUUUUUUUUUTGRGGAGAGUUUURGRGAUAGUUTUUUUAAUAUUTGTGAA TUAURGGAGGUGUUAURGURGAGRGAURGXGUAUUAUUUUTTUURGGGUURGG GUARGGUUAGGGAGGAUAGUTAGGGUUGUUGUUTTAUAATUAUAUUUTTAAUTUUTAAT ARGAUUAGUAUAAGUAGUUUTGUTUUUURGUUUTGATTTGAGUAUARGAGGGUUUUU RGAGGUAG |
| 160 | UTGUUTRGGGGGGUUUUTRGGAUGUUAAATUAGGGGRGGGGAGAUAAAGGUTAUUTGTG UTGGTRGUAUUAGAGATUAAAAGUGAUAAUUAUAAAGUAAUAAUUUAAUTGUUUTUUU TGGURGTGUURGGGUURGGGAAGGGGGGGTGGTGXGRGGAATRGUTRGGRGGUTGGUAGUUT UURGGATGATUAUAGGUGUUTGGGGAGGGUGTGRGRGGGGGUUTURGUAGGGAGGGAGG GUTGGGGAGRGRGTGGGAGGTGGGGGAUUTRGTUTGAGGAAUTGUUTGUAUUUUURGG GAAGGATG |
| 161 | URGGAGARGAUUTUAGGGUUTGGGTGAGGRGUTGAUUUUUAGGGAGUTGGGGUGURGAGG GGRGRGGGUUAUAGRGGTGRGAGUUAGUTRGGGRGUURGRGRGGTGGGGRGRGRGGRGR GGGGAUUGGRGGGRGUTUUURGGTGUUXGUAGUTUTUAGXGTAGURGGGAAGAGURG RGRGTUTGRGRGUUAGUUUURGUUUTGGGUUURGURGUURGAGUTUTUTGGRGUAGRGU TAGUTURGURGRGUUUAGUGUUUTGRGURGGUAUUUUUTGGTUATGAGRGUUUUUTRG ARGUTGUUUU |
| 162 | GGGGUAGRGURGAGGGGGRGUUAUGAUUAGGGGUGURGGRGUAGGGUAGUGAGRGR GGRGGAGUAGRGUTGRGUUAGAGAGUURGGGRGGRGGGUUUAGGGRGGGGGUTGGR GRGUAGARGRGRGGGUTUTUURGGUUAXGUTGAAGAGUTGXGGGGUAURGGGGAGRGUU RGUUAAUUUURGRGURGRGRGUUUUAURGRGRGGGRGUURGAUTGGUTRGUAURGUTG TGGUURGRGUUUUUTRGGUAUUUUAGUUUTGGGGGUAGRGUUUAUUUAGUUUTGGA GTRGTUTURGG |
| 163 | RGTGUUARGUAAARGURGTRGUTURGUAURGGTRGRGAUTRGGUAAGGGAGRGGGRGGA GAGUTGAUTRGGRGGAGGGGGGTUAUTRGURGGARGGAARGUTGRGRGUAGUUAUR GUTRGUTGUUAGURGRGTUUUAAUURGUTAGGAXGUTGGGUUTGURGGRGGGATUUT UUUUTTAUTRGGAAAGGGGGAGGRGURGGUUAUAGTAGGRGARGAGURGRGUTRGGUUA UUAURGRGGTGGURGGRGGAAUUUUTRGUTUTUUUURGTUAUUURGTRGAGGGGGAAG UTGAGGAGGG |
| 164 | UUUTUUTAGUTTUUUUUUTRGARGGGGTGARGGGGGGAGAGRGAGGGTTURGURGGUU AURGRGGTGGTGGURGAGRGRGGUTRGTRGUUTAUTGTGGURGGRGUUTUUUUTTURG AGTAAGGGGAGGAUUURGURGGUAGGGUUUAGXGTUUTAGRGGGTTGGGARGRGGUTG AUAGRGAGRGATGGUTGRGRGUAGRGTTURGTURGGRGAGTGAUUUUUTURGURGRG AGTUAGUTUTURGUURGUTUUUTTGURGAGTRGRGAURGGTGRGGARGARGGRGTTTGR GTGGUARG |
| 165 | UURGGRGAGARGAAUGUAGUAUARGGURGUUTTATGGGGUUURGUAGAUAGRGRGTRG UUAGGUTAAUUUTGRGTGGAAAATTRGGAGGTGGAAGGRGAGGRGUUTATTGAGGGG GURGGUAGRGGRGGRGGRGGRGAGGGGGRGGXGGGGGUTGTGRGGUURGGGURG GAAARGTGAGURGGGUTGGGGRGGRGAUUAUUUURGRGUAUUUUURGGUUUTUURGG GAUUAURGRGRGUUURGGURGGUAGGTGGAGGAGUAGGAGGRGUUUAURGUUUR GUUUTGGGAGGA |
| 166 | TUUTUUUAGGGRGGGGARGGTGAGGGRGUUTUUTGUTUUTUUAUUTGURGGURGGGGR GRGRGGTGGUURGGGAGGGURGGGGAAUGRGRGGGGGTGGTRGURGUUUUAGUURG GUUAGRGTTUURGGUURGGGURGUAUAGUUUUXGURGUUUUUTRGURGURGURGURGU |

TABLE 4-continued

Sequences Listed in Table 1

| SEQ ID NO: | Sequence |
|---|---|
| | RGUTGURGGUUUUUTUAAUAAGGRGUUTRGUUTUUUAUUTURGAAUUUUAARGUAGG<br>GUUAGUUUGGRGARGRGUUGUUUGRGGGGUUUUUAUAAAGGRGGURGUGUGUAUURGU<br>UURGURGGG |
| 167 | TUTGAUGGTGGURGRGUGUUGGGUUUAGUAGUUUUUGGAGUUUAUAUAUURGAAAUAA<br>AUAUUUUURGGUAGUUAUGGAAGUUGGAGUUGAGAAGUURGGGRGGGGGUGUUUGURG<br>GAUGUUUURGGUUUUUUUUUUUUUUAUURGUXGUUAAAUUAAUUUUURGGGGGGAUGG<br>AURGGUUGGUUGAGAAAGAGGAUARGUAUAUURGGUGUGAARGAGGGUUARGAAUUUUU<br>UGAUUUUAGGGAGAGAUUUUUGUUAAGRGUAAGGUGUUUUUGGAUUUUUUUAUUUUGU<br>UUUAGGU |
| 168 | AUUUGGGAUAGAGGUGGGGGGAUUUAAAGAUAUUUUUARGUUUGGGUAGAAAUAUUUUUUUU<br>UGGGGUUAGAGGGUURGUGAUUUUGUUUAUAURGAGUAUGRGUGUUUUUUUUUUUAAUU<br>AGURGAUUUAUUUUURGGAAAAGUUAAGUUGGXGGRGAGUGGGAAAAGAGGGAAURG<br>GGGGUAURGGUAGGUAUUUURGUURGGGGUUUUUAGUUUUAAUUUUAUGGUAURG<br>AGAAAUAUUUAUUUUGAGUAGAUGGGUUUAGGGGUAUUGAAGUUUAAUARGRGGUU<br>AUUAUAGA |
| 169 | GGRGGRGAURGGAGRGGRGGRGGUGGUUURGGRGGRGGRGGRGGRGGRGGUAGGG<br>AGRGGGUUURGGUGURGGGUAURGGGRGGGRGGRGGGGAAGAUGAURGRGGRGURG<br>GRGUGUUUUUUUUGUGUUUURGUUUUURGGRGXGUUURGGGUAAGUUGURGUUUUUURG<br>UUUUURGURGUUUGGAAGUUUURGGGUAGRGGGAGGUUGUUUUURGGAUUURGRGGGGRGU<br>UAUAUAUURGGRGGGGUUUUUURGGGGUUUUUURGURGRGUUUUURGUUGUAUUUAGU<br>URGGRGUUU |
| 170 | GGGRGURGGGUUGGAUGUAGRGGGGAGRGRGGRGGGGGAGUURGGGAGAGUUUUGUR<br>GGGUGUGUGAGRGUUUURGRGGGAUURGGGGARGAUUUURGUUGUURGGGGUUUURGA<br>ARGGRGGGGRGGGAGGRGGUAAUUUAUURGGAGXGRGURGGAGAGRGAGUAGUA<br>GAAGGAGUARGURGRGUURGRGGUUAUAUUUUUURGUURGUURUUURGUURGGUAU<br>RGGGAGUURGUUUUUUGURGURGURGURGURGURGURGAGAUUAUURGURGURGUU<br>URGAUURGURGUU |
| 171 | URGRGUUGRGGGUGGGRGGRGGGGUAGGAUUGRGGGGUAUUUUAUUUUURGAGUUUUR<br>GGRGGGGGUUGGAGUUUGRGUGUURGGRGGGGUUURGGGGGUUGGGAGUUGGURGGGU<br>UUGGGURGGGAAGURGGARGURGGGRGGGRGRGGGXGRGGGGAGGGRGUUURGGGAGGG<br>RGAGRGGGUUUUURGUUUGUUUGUAGAGUUUURGRGGGURGGAUUGUUAGUUUUGUUU<br>GRGUUUGGRGAGGUGRGRGGUURGRGGGGGUAGAGAGRGRGGRGGUURGGGGGRGUU<br>UUUGGGRGGA |
| 172 | UURGUUUAGGGGGRGUUUUURGGAGURGURGRGUUUUUGUUUURGRGGGURGRGUAUUU<br>RGUUAGGRGUAGAGUAAAGUUGGUAAUURGGUURGRGGGGUUUUGUAGAGGUAGRGG<br>GAGAUUURGUUGUUUUGGGGGRGUUUUURGXGURGUUURGUURGGRGRGURGGUU<br>UUURGGUUUAAGUURGGUUUAGUUUUUAGUUUUUURGGGGUUUURGURGGAUARGUAGGU<br>UUUAGUUUURGURGAGGGUURGGGGGUGAGAGUGUUUURGUAGUUUAUUUURGURGUUUA<br>UURGUAGRGRGG |
| 173 | UURGGRGUURGRGUUUUURGGRGRGRGUUUUGGGGAURGGGUUGGUGGRGUUURGRGU<br>GGGGUURGGUGGGUUUUURGGAGGGUUURGGGGGUURGGUUUGGGRGRGUGRGGGGGGA<br>GGAGARGGUURGGGGGAURGGURGRGAUURGRGXGGRGGUGGUGGGGGGAGURGRGG<br>GGAURGURGAGGGURGGUGGURGUUURGGGUGURGRGRGGUGURGURGGRGGRGGUG<br>AGGUUURGRGRGUGUGUUURGGUUGRGGUURGGURGRGUURGAGGGGUUUURGUGGRGU<br>UUUUUUUUUU |
| 174 | GGGGAAGGGGARGUUARGGGGAUUUUURGAGRGRGGGURGAURGUAGURGGGAUAUAR<br>GRGRGGGGUUUAURGURGURGGRGGUAURGRGRGGGUAUUGGGGRGGURGAURGGU<br>UUURGGRGAUUUURGRGGUUUUUUUAUUAURGUXGURGUAGURGRGGURGGUUUUUR<br>GGAAURGUUUUUUUURGUARGRGURGUAGGURGAUUUUURGGAAUUUURGGGAAG<br>UUUAURGGGUUUUARGRGGGGRGUUAUUAAUURGGUUUUUUAAGGRGRGRGURGGGGG<br>ARGRGGARGURGGG |
| 175 | UUUUUUURGRGRGUUUUUURGUGRGUUUUURGGGUUUURGGUURGUGGUUUUUGUUUUUUUURGG<br>UURGUUUUUURGAAURGGUURGGRGRGUUUUUUGGGUGRGUUURGUUUURGGGGGUUUGU<br>RGRGGGUUUUUUUURGAGGRGUURGUUURGGGGXGUURGGRGUURGGGGGAGAGUURGUUUUUU<br>UUURGRGUGGRGURGUUURGUUURGGRGRGRGRGUGRGUURGAGRGRGGUURGGUGGUUU<br>UUUURGGAUAGGRGUURGUGRGARGUGUGGRGUGGGURGAUUUURGUUUUGURGGRGU<br>URGUUUU |
| 176 | AGGGRGAGRGAUURGGUAAGGRGGAGGUURGAUUUARGUUUAUARGUGUARGAARGUUUG<br>UURGGGAGGGAUUAUURGGGURGRGUURGGGRGUARGRGRGRGURGAARGGGGRGARGU<br>UARGRGGGGAGGARGGGUUUUUUURGARGURGAXGUURGGGARGGARGUURGGGGA<br>AGGGUURGRGGUAGGUURGGGAAGRGAGGRGUAUURGGGGGARGRGURGAUURGGUUR<br>GGAAGAGRGGGURGGGAGAAGARGAGAGAUUARGGGRGAGGURGGGGRGARGGGGAA<br>GGRGRGAGAAAGG |

TABLE 4-continued

Sequences Listed in Table 1

| SEQ ID NO: | Sequence |
|---|---|
| 177 | GGGRGGGTGGTTGGGGRGTURGGTTRGURGRGUUURGUUURGGUUUUAURGGTUURGG URGURGUUUURGRGUURGURGUTRGUTUUUTUURGTURGUURGTURGRGGUURGTURGTUR GTURGTURGTRGTUUTUUTRGUTTGRGGGGRGUXGGGUURGTUUTRGRGAGGUUUUURG GURGGURGTURGGURGRGTRGGGGUUTRGURGRGUTUTAUUTAUUTAUUTGGTTGATUU TGUUAGTAGUATATGUTTGUTUUAAAGATTAAGUUATGUATGTUTAAGTARGUARGGUR GGTAUAG |
| 178 | UTGTAURGGURGTGRGTAUTTAGAUATGUATGGUTTAATUTTTGAGAUAAGUATATGUT AUTGGUAGGAUUAAUUAGGUAGGUAGGUAGAGRGRGGRGAGGUUURGARGRGGURGGA RGGURGGURGGGGGGUUTRGRGAGGARGGGUUXGGRGUUURGUAAGRGAGGAGGARG ARGGARGGARGGARGGARGGGURGRGGARGGRGGARGGGAGGGAGRGAGRGGGRGR GGGGGRGGRGGURGGGAURGGTGGGGURGGGGRGGGGRGRGGRGAAURGGARGUUUU AAUUAUURGUUU |
| 179 | TATTUAGAUTGGGAGUTGGGGTUAGAGTGTUTURGTUTURGGAGGGGGAUUTUUAGA UUURGGGRGGGAGGGGUUUAUAGUAGGGTGUUURGGRGGUUUUAGGAGGGGGTURGG GUUTRGGGRGAAGGUTGRGGRGUUURGGAAGGAGUXGRGUARGUUUUTGUARGRGGTG UURGUTGRGGAGGUUARGGAUARGGAGGTGAGAGRGUUUURGUUUURGUTUUUTGUUUA GUURGRGRGGUURGGTURGGGGUTGGGGGRGGRGUUAAGAGGGGRGURGGGRGU AGTGGGRGGUU |
| 180 | GGURGUUUUAUTGRGUURGGRGUUUUTUTTGGRGUURGUUUUUAGUUURGGAURGGGU RGRGRGRGGGUTGGGUAGGGAGRGGGRGGGGRGUTUTAUUTURGGAUURGTGGUU TURGUAGRGGGUAURGRGTGUAGGGGRGTGRGXGGUTUUTTURGGGGRGURGUAGUUT TRGUURGAGGUURGGAUUUUUTUUTGGGGURGURGGGGUAUUUTGUTGTGGGUUUUTU URGUURGGGGTUTGGAAGGTUUUUUTURGGAGARGGAGAUAUTUTGAUUUUAGUUUUU AGTUTGAATA |
| 181 | GRGAUTTRGTUTGGUUUUAAAAUUTTTGUUUTUUAUUUUUUAGRGTUURGGAURGGTUU TTGUTUATUTUTAGGGGUAAUAUUTGAUUUARGGGGUURGTUURGGAGUTUTUTTRG AUTURGGGAUUAGTTUUUAGUUUTTAGTAUTXGGUAUAURGGAAGGAGGATTUUTGU TUUUTTUTUTUUTUUTAGAUUURGAGGUTTGGAGUUTAUTUTUUAGATGAGAUUAAAAAA GUUUTAAATTAATUUUUUUTATAGRGUAUUUUTUUUTRGUAGRGUUUTGGTRGGGGGUU TUUATTGT |
| 182 | AUAATGGAGGUUUURGAUUAGGGRGUUGRGAGGGAGGGGTGRGUTATAGGGGGATTAA TTTAGGGUUTTTTAGTUUTATUTGGAGAGUAAGUTUUAAGUUTRGGGGUUAGGAGGAG AGAAGGGAGUAGGAAUUUUUUTURGGUATGUXGAGUAUTGAAGGGUTGGGAAUTGGT UURGGAGUGAAGAGAGUUURGGGARGGGUUURGTGGGUAGGTGUUUGUUUUTGAGAG ATGAGUAAGGAUGGUGTURGGGARGUGGGGAATGGAGGGUAAAGGTUUUGGGUUAGA RGAAGTRGU |
| 183 | UUARGGUURGAGGGGURGGAGUGUUUUTGTGRGAGGGAGUUUTGGURGRGGRUAGGT AGGAUURGGGAAUUUAAGGAGGGRGGGAGGAAAGRGUUUUUTGGTGGGGAGGGGURG TGGRGGGGTUTGGGGGUUAAGGGUUARGGGURGAAXGAGGGGUAUUARGURGGAGUAG UUUUAGUUTGGGAGUAUUTGGGRGTGAARGTGGGGGAAAGTAGGGAUUAGAUUAUAGGA TUAAGGUUUUUURGGUUAGAAUUGGATUGUTUAGTGUUUUUTAGAAGGGGUAGRGGG TRGUUUARGRGA |
| 184 | TRGRGTGGGRGAUURGUTGUUUUTTUTAGGGGUAUTGAAUAAUUUAGTUUTGAGURGG GGAAAGUUTTGATUUTGUAATUTGGUUUUTAUTUUUUUAARGTUARGUUUAAUTUGTU UUAGGUGGAGUGUTURGRGTGUGUUUUTXGTTRGGUURGGAGUUUTTGGUUUUUA GAUUURGUUARGGUUUUUUUUUAUUAGGGGRGUTTTUUTUURGUUUTUUTTGGGTTU UURGGUUUAUUTGRGURGRGGUUAGGGUUUUUTRGUAUAGAGGUAGUURGGUUUUT RGGURGTGG |
| 185 | GAGAARGGAGUTGUURGTGRGGGGTGRGRGUUAAGGRGGGGGAUAGGARGGGUURGG RGTUTGRGAGAUUUAGGTUGUURGUAUTURGUTRGRGGUUUUUUTUTGUUTUURGUT UTAGRGGRGURGGAGURGXGUTGUUURGUUUURGUURGGUAGUUUXGXGAGTUAG AGUURGGTGUUUUUAGAUUGRGGGUAGTRGGGGUUTAUTUURGGGUUAGAGUAGGAA AGAGUURGAUUUAUUTUUTRGGUUTUUUAGGGAAUUUUUTUTRGGAGGGRGUUUTGG GUUTURGRGUUA |
| 186 | TGGRGRGGAGGUUUAGGGRGUUUUTURGAGAAGGGGUUUUUTGGAAGAAURGAGGAGGT GGGTRGGGUTUTTUUTGUTUTGGUURGGAATGAGGUUUURGAUTGUURGRGGTUTGGG GGUAURGGGUUTUTGAUTXGXGGGAGUTGURGGGRGGGGRGGGGGUUAGXGRGGUTUR GGRGURGUTAGAGRGGGAGGUAGAAGGGGAGURGRGAGRGGAATGRGGGUAGUUTAG GTUTRGGUAGARGURGGGUURGTUUTGTUUUURGUUTTGGRGRGUAUUURGUARGGGU AGUTURGTTUTU |
| 187 | AGTAGGTGAAUTTGAGGTAGAAGRGGGARGTGTAUTTUTURGGUTGURGGTRGGGGTRG RGGUTUTRGTTGAGRGTGTUUURGAAGAUUUUUTTGGUUAGRGRGATGRGUURGTAUA UUATGATGRGRGUUAUARGURGGAATTTGGRGTXGGUUTGGTTGTRGRGUARGGTGGTG TAGGAGUUURGGTAGUUUAGRGTGAGGAAGUURGAGRGUUTGTUUTGRGRGURGURGU |

TABLE 4-continued

Sequences Listed in Table 1

| SEQ ID NO: | Sequence |
|---|---|
|  | RGURGUUAUUAURGTGRGUTUURGGGUURGAGGGUARGGRGGURGURGUUURGRGUA GUAGUAGRG |
| 188 | RGUTGUTGUTGRGRGGGGRGGRGGURGURGTGUUUTRGGGUURGGGAGRGUARGGTGG TGGRGGRGGRGGRGRGRGRGUAGGAUAAGRGUTRGGGUUTTUUTUARGUTGGGUTAURGG GGUTUUTAUAUUAURGTGRGRGAUAAUUAGGUXGARGUUAAATTURGGRGTGTGGRGR GUAUAUGGTGTGRGGGRGUATRGRGUTGGUUAAGGAGGTUTTRGGGGAUARGUTUAA RGAGAGURGRGAUUURGAURGGUAGURGGAGAAGTAUARGTUURGUTTUTAUUUAAG TTUAUUTAUT |
| 189 | GURGRGAUUUUTGRGUTUUUAGUAGGGUUAAGAGGGAUUTRGRGGGUAUUAGRGTURG GGRGGGAAGGGARGTGTGUUUAAGUUTRGUUTUUTGGUUUTUAGTGGGUTGGGARGUU UTTGAUUAURGGRGUAGGAAAGAGGGUUUUUAGUUXGTGAGUTTRGTURGGGRGUUAG GGUAGGGATGGUTGGTGGTGTGUAUTGGAGAGUARGARGGTGARGUTGRGTGGGAAAG AGARGTGGGAAGGGUAUAGURGGATTAUUUAUUAGUTUUAAUUTTUUTUUAAGRGUUA UUAUUUUAUA |
| 190 | TGTGGGGTGAGTGGRGUUTGGAGAAAATTGGAGUTGAGTGGAUAAUURGGUAUGUUUT TUUUUARGTUTUUTTTUUUUARGUAGRGTUAURGTRGTGUTUTUUAGTGUAUAUUAUUAGU UAUUUUTGUUUTGGRGUURGGARGAAGUUAXGGGUTGGGGAGUUTUTTTUUTGRGUR GGTGAUUAAGGGRGUUUUAGUUUAUTGAGGGUUAGGAGGRGAGGUUTGGGUAUARGTU UUTTUURGTUURGGARGUUGGTGUURGRGAGGTUUTUTTGGUUUTGUTGGGAGRGUAGG GGTRGRGGU |
| 191 | CTGGGTTTGGAGTTGGGTAGRGRGGCCAGGTGARGGTCTCCTTCCCTGGGCRGTCAGGGC TGCAGGRGGCTGTGACACTCRGGAGGCCTRGACAGAGGGGTCCCAGGRGCAGRGTACCR GGGCTCCTCTTGCCTCAGRGGAGRGTCCCAXGGCAGTCCRGGACCRGRGCCTCTCCRGCC RGGCTCCTGCARGCCCAGRGAGCCTGCAGCCTGGGATCCTCRGCTCCTGCATCCRGGCTR GGGATGGGTCCRGGCTCCCCACCTCARGCRGGRGGGGCCACCCTTTCACTCRGCCTCCAT C |
| 192 | GATGGAGGRGGAGTGAAAGGGTGGCCCRGCRGGRGTGAGGTGGGGAGCRGGGACCCAT CCRGAGCRGGGATGCAGGAGRGGAGGATCCCAGGCTGCAGGCTRGCTGGGRGTGCAGG AGCRGGGRGGGAGAGGRGRGGGTCRGGGACTGCXGTGGGARGCTCRGCTGAGGCAAGA GGAGCCRGGGTARGCTGRGCCTGGGACCCCTCTGTRGAGGCCTCRGGAGTGTCACAGCR GCCTGCAGCCCTGARGGCCCAGGGAAGGAGACRGTCACCTGGCRGRGCTACCCAACTCC AAACCCAG |
| 193 | UUUTUAUUTUTAGUUUUTRGGUTUAGUTUAGGUUUUTRGGGGAGUAUUUUTTGURGT GAGAUTGAUAGUUUTTGGGGGRGUAGGGTUUTGTTUUTGRGUTUTAGUUUAUTGUGR GUAGAGUUTRGTUUUUAGGRGUUTGGAAUURGGXGGGUAUUGARGUUAAGRGURGGRG GAGRGUTGUUUAUAGARGGTTGAUURGGGUUUTUUTUUAUAUUUUUTTUUTTUTTRGU UUUTUUUTUTTTUUTGUARGGGGGUTRGGGUUAUTATAAAAGGTGGGAGRGRGTGGT GUUUUAGU |
| 194 | GUTGGGGUAUUARGRGUTUUUAUUTTTATAGTGAGUUTRGAGUUUURGTGUAGGAAAG AGGGAGGAGGRGAAGAAGGAAGGGGGTGTGGAGGAGGGUUURGGGTUAAURGTUTGTA GGUAGRGUTURGURGGRGUTTGARGTUAATGUUXGURGGGTTUUAGGRGUUTGGGAAR GAGGUTUTGRGUAUAGATGGGUTAGAGRGUAGAGAAUAGGAUUUTGRGUUUUUAAAG GUTGUAGTUTUARGGUAAGGGATGUTUUURGAGGGGUUTGAGUTGAAGURGAGGGGU TAGAGGTGAGGG |
| 195 | TTGUTGUTAAATGUAUAAAAGTUAUUTAAAGGUAUAGAGGAGGURGUTUTGTTTTTGR GAAAUTTGUTAAAATTAATUTGRGUTGGGUUAUTTGUAGAAAGUAGAAUUAUUTUURG UUUUAUUTRGUUTUUAGURGURGGGGTUAGGXGTTTGTGAAAGAUAGAAUUTTUGG GUTAGGGAUURGGGUAUTGGTGUTTRGAAGTURGAAUURGURGGURGAGAAAARGAUA AGAGAAAGAAAAUUUAGRGGGRGUTUTUTUUAGRGUUAGGURGGTGTAGGAGGGRGUT GGGGUTRGG |
| 196 | URGAGUUUUAGRGUUUUUUTAUAURGGUUTGGRGUTGGAGAGAGRGUUURGTGGATTT TUTTTUTUTTGTRGTTTUTRGGURGGRGGATTRGGAUTTRGAAGUAUUAGTGUURGGGT UUUTAGUUUAAAGGTTUTGTUTTTUAUAAAXGUUTGAAUUURGRGGUTGGAGGRGAG GTGGGGRGGGAGGTGGTTUTGUTTTUTGUAAGTGGUUUAGRGUAGAUUAATTTTAGUA AGTTTTRGUAAAAAUAGAGRGGUUTUUUTGTGUUTTTAGGTGAUTTTTGTGAUATTTAG UAGUAA |
| 197 | AURGAGRGUTGGAGGURGUTUUARGRGRGAGUTRGAAUUARGGAGGGUTUTTAGUTRG GAUAAGRGTRGUTGTUTAAGAGUTUUAAGUTUUARGGAAUTTTGATTTTATGUURGGGA GUURGGTUAUUUAUTTUTGUAUTUTAGAUAAGXGURGGAGGUTRGTGUAGUTUUTRG RGTUUTUTTUUTGGARGRGGGRGUUUAUUTTAGTUAUAGUUUUUTGGTUURGGUAUG UUARGURGTRGGTTTUUUUAUTGUUUAGGUTUUUTAGUURGAAUUUTGRGTUTUTGT TUAUATTG |
| 198 | UAATGUGAAUAGAGARGUAGGGUTRGGGUTGAGGGAGUUTGGGUAGTGGGAAAURGA RGGRGTGAGUAGTGURGGGAUUAGGGGUTATGAUUAAGGTGGGGRGUUURGRGTUUAGG |

TABLE 4-continued

Sequences Listed in Table 1

| SEQ ID NO: | Sequence |
|---|---|
|  | AAGAGGARGRGAGGAAGUTGUARGAGUUUTRGGXGUTTGTUTGAGAUGUAGAAGUGGA<br>TGAURGGGUTUURGGGUAUAAAAUAAAGUUURGUGGAGUUUGGAGUUUUUAGAUAGR<br>GARGUUUGUURGAGUUGAGAGUUUUURGUGGUUUGAGUURGRGRGUGGAGRGGUUUUA<br>GRGUUUGGU |
| 199 | AAUAGUAGGUUGAAUUAGAAUUAAGAGAAAAUUGGGUAGAGAGAAGGUAAUGGRGAG<br>UUUAUUUAGGGGUGUGGGGUGRGGAGAGUUGUGUGUUUUUUAUGUUUUGGGGARG<br>UUGUGRGAGUUAGGAUURGGGUAGAUURGUAUUXGAUGURGGAGGAGUUGGAUAAAG<br>GUUUUUURGUURGGUAAUAUAGUUAAGGAUUUUGGGUUGGAGUUUUAGGAGUUGGRGGA<br>GRGRGGAGUURGUAURGUUUUUAGAGGUAGGARGUAGUUUUUUGUUUUGAAUURGRGA<br>AGRGGUAGUUU |
| 200 | AAGUGURGUUURGRGGGUUAAGGGUAAAAAGUGRGUUUAUUUUGGAGARGAUGR<br>GGAUURGRGUUURGUUAGUUUGGGGGUUUAGUUUAAGGUUUUGGGUAUGUUUGUR<br>GARGAAGGAGUUUUGUUUAGUUUUUURGGGUAUXGAGUAGRGGAUUGUURGGAUUU<br>GGUURGUAUAGRGUUUUUAGGAGUAUGAAGGGUAGUAGUAGUUGUURGUAGUUUUAG<br>UUUUUAGGUGGAUURGUUAUUGUUUUUUGUGUUUAAUUUUUGUAGUUGGGUUAG<br>UUUGUUGUU |
| 201 | GGUGUUUURGRGAGUAGGUGUUAGUAGUGRGRGUUUAGGRGUARGURGGGUAGUAGU<br>URGGGGURGGRGUUGARGRGGUUUAGRGRGUAUAGUAUGGUUUUUAGURGGUGUARGU<br>UUGUGUUUUUUUAGUGUURGUARGUURGGUUXGURGRGUUURGRGRGUGUAURGG<br>GAAUAGGURGUUUAGRGUUAGGURGUURGUUAGGRGUAUAGAGUUGURGRGRGRGU<br>UAGGUURGUUUGRGUUAGUUARGUUAGRGGUAGUAGRGUUAAGAGUAGRGGUUUURG<br>GGUUUUURGGGG |
| 202 | UUURGGAGAGUURGGGAGURGUUGUURGUGGRGUUGUUGURGUUGGRGUGGUUGGRGU<br>AGGRGGGUUUGGRGRGRGRGGRGGGUGUUUUGUGRGUUUGGRGGGRGGGUUUGARGUUGGG<br>RGGUUUGUUUURGGUGUARGRGRGGGGRGRGGXGGGURGGGRGUGRGGGUAGUGAAG<br>AAGGAGUAGGGRGUGUAURGGGUUGGAGGUUAUGUUGUARGRGUUGGAURGRGUUAARG<br>URGAUUURGAGUUGUGUURGGRGUGURGUUUGGGRGRGRGGUUGUGGAUAUGUUR<br>GRGGGAUAUU |
| 203 | GAAUUAGGGUAGGUAUAGUAAAGGUAAUAGGUGGGARGGGGAGUUAGGGAGUGGAAA<br>RGURGGAGGUUUUAGGUUGGGAUUURGGAGUUUUURGUUAGAUUURGAUUURGGAG<br>AAGGUUAAUUURGGGAUUUUAUUUAUGUUUUAUUUXGGGUAUUUUUUAAAAGUAGG<br>GGUGGGAGGGUAUAAGURGGUAAGUAUUUUUURGGGUUUURGGGAGUAAUAUUUGUUU<br>AAGRGUUAUAUUUAAGRGUAUUGGAUUGGGAAAUAUUUGGAGAUAUUGAUUAAGAAAU<br>AUUAAAUU |
| 204 | AGGUUUGAGUAUUUUUAAAUAAUGAUUUUAAAUGUUUUUUAGUUUAAUGRGUUAAAUA<br>UGAARGUUAGGUAAGAUUGUUURGGAAGGUUUGGGAAAUAUUUGAURGGUUUAUGUU<br>UUUUUUAUUUUUAUUUUUGAGGAAGGUGUUXGGAAUGGGAUAUGGAUAGGGUUURGGA<br>AUUGGUUUUUURGGAAUUGGAAUUUGAGRGAGGAUURGGGAUUUUUAGUUUGAGGA<br>UUUURGGRGUUUUUAUUUUUGGUUUUURGUUUUAUUGUUGUUUUGUAUAUGUUAUU<br>UUGGUUU |
| 205 | UUUUGRUGGUAGRGUUUGGUUUGGGRGUURGURGUUUGGUUAUGGAGGUAUAGUG<br>GURGRGUUURGGGGAGUUGGGUUUUUUGRGGUUURGAGUUURGRGGRGUURGRGU<br>UURGAUUUUGGUUURGGUUUUUUUAGGUUXGGUUGUUUURGGUUUUUAUUGAUUU<br>RGUUAGURGUAUUAUUUAAUUUUUUUUURGUAGARGUAAAUUURGAAUARGUUURGGU<br>UUUGGGUUUAGGGUUUGGUUGGUUUGUUGGUUUAUAGGAUUGGGGGRGGGGUAGGUR<br>GGUAGAGU |
| 206 | GUUUUGURGGUUAUUUUGUUUURGAAUUUGUAGAGUUAGGRGAGGURGAGGUUUUA<br>GGUUUAAGGURGGGGRGUAUUGGGUUAARGUUGRGGGAGAAAGAGGUGGUGGUGR<br>GGUGGRGAAGUAGUGAGGGAUURGGAGAUAGUXGGGGUUGAGAGAGURGGGAUURG<br>GAGAGURGGGGRGRGGGRGURGRGGAGGUUUGGAGURGUAAGGAGGUUUAGGUUUUU<br>RGGGARGRGGUUUAUUGUAUUUUUAUAGUUAAAGRGGRGGGRGUUUAAGGUUAGAGRG<br>UUAURGARGAGAA |
| 207 | RGUAUAURGARGGGUUUUGGGUUGGRGGGGARGAUUGARGUUGARGGUUGARGGGG<br>GURGUUGGGAGUUGUUURGURGAGGUGGAUUUGGGGRGUURGUAUUUUUUAUUUUUUU<br>URGUGGGUUGGGGUUUAGGGARGUAGRGGGGGAXGGRGGGUAUUAGURGGGUAGRG<br>UURGAGURGUUUUGGURGGGUUUUUUAUAUUUGRGUGUUGRGGGUAUUUUAGGGUUGG<br>GGGRGRGGUGAAUGUGGUUUURGUAGUURGGGGUURGUUAGGUURGRGGAGUUAGUU<br>UAUUUGGRGA |
| 208 | URGUUAGGGUGGGUGAUUURGRGGGUUUGGRGGGUUUUGGGUUGRGGGAUUARGAU<br>UAAURGRGUUUURGAUUUUGGGGAUGUURGAGUARGUAGGUUGGGGAUUURGGUUAG<br>GGARGGUURGGGRGUUGUURGGUUGAUGUURGUXGUUUUURGUUGRGUUUUGGUUUR<br>GGAUUUUAAGGAAAGAAGGUGAGGGGUGRGGGRGUUUGGGUUUAUUUGGRGGAGU<br>AGUUUUUAAGGGUUUURGRGGGUUUUUAGUUURGGGUURGUUUURGURGAAUUGGGAGGU<br>RGURGGUGUGRG |

TABLE 4-continued

Sequences Listed in Table 1

| SEQ ID NO: | Sequence |
|---|---|
| 209 | GAUUAAAAGGAGUTURGRGUUAGGURGGAGGUTGRGUURGTUAUTRGRGGTUURGGUR GGGTUUUTGGRGRGTAGTUAGGURGUAURGUURGAGUUUUAUGRGRGUUUAUUURGG URGGGTGRGTURGGUTRGRGGURGTUUUTUURGXGAUUTGTGGUURGGGGUTGUTGRG GGRGUURGGGGAAGAGAGGRGGGGGURGRGGGGGGUAGGAGGAGRGGUTGRGGURGG UAUAGRGUUAGGGRGAGTGAGGRGGGTGGRGRGGGGGAGGRGGRGGAGTAAAGAGAG GURGURGGUTGG |
| 210 | UUAGURGGRGGUUTUTUTTTAUTURGURGUUTUUUURGRGUUAUURGUUTUAUTRGUU UTGGRGUTGTGURGGURGUAGURGUTUUTUTGUUUUURGRGGUUUURGUUTUTUTTU UURGGGRGUURGUAGUAGUUURGGGUUAUAGGTXGRGGGAGGGARGGURGRGAGURG GARGUAUURGGURGGGGTGGGRGRGRGGTGGGGUTRGGGRGGTGRGGUUTGAUTARGR GUUAGGGAUURGGURGGGAURGRGAGTGARGGGRGUAGUUUURGGUUTGGRGRGGAG UUUUUTTTGGTU |
| 211 | GURGGUAUUTGURGUTURGUURGGGATTAGGGAGUUUURGGUUTGTGGGGGGTGRGGG RGGURGGTGGTUUAGUURGUURGUUURGGURGAGARGUTGGGUURGGUUUUUAUAGG UTGRGUUTGARGGGAURGGRGGGAGGUUUTTGTTXGUAGUURGGAGGUUUUUAGGUUU AAAUUAUAUTRGGGUTGRGGGGAGRGAGRGRGGGRGTTGURGUTAATTGUTGUTAATTT TGTTUUAUTTAAUTTTAUTUTTGAAUUUUTTAATTGTTTTUUAUTTATTTTTAGTAAT TTTAAUTTTAAUTTTTATTT |
| 212 | TTATAAAATTAUTAAAAATAAGTGGAAAAUAAUUAAGGGGTTUAAGAGTAAATAAAGTT AATGGAAUAAAATTAGUAGUAAUUAGRGGUAARGUURGRGUTRGUTUUURGUAGUURG AGTGTGGUUTGGAGUUTGGGGUUUURGGGUTGXGAAUAAAGGUUTUURGURGGUURG UAGGRGUAGUUTGTGGGGGURGGGUUUUAGRGTUTRGGURGGGGRGGGRGAGUTGGAU UAURGGURGUURGUAUUUUUAUAAGURGGGAGUTUUUTAAUUUGGGRGGAGRGGU AGGTGURGGU |
| 213 | TUAGUAURGGGGAUAGUTUUUTGUUTRGUUAAUTTRGGUAGUTUTTUTRGATGTUTRGUR GRGGGUTGTGUUUUAUAGGUTARGGGAGGGGAGAGTGUUUUUUARGURGGGGTUURG GUUUUTGGGUTTTAGGGAGRGRGAATGGGUUUUARGAUAGUAARGGGAGUAGURGGTGG RGUUUAGGUTGRGGGTGGUAARGAGUURGAUTGUAUTARGGUUUTGRGGGAURGRGUU AGRGRGGAGGAGAURGAGUUUAUUUAGRGGGURGGGURGGAUUUAGGTGAGRGGUU UTGGUTUUUU |
| 214 | GGGGAGUUAGGGURGUUUAUUUTGGGUURGGUURGGUURGUTGAGATGGGUURGGTGUU UTURGRGUTGGRGRGGTUURGUAAAGURGTAGTGUAGTRGGGUTRGTTGUUAURGUAG UUUGAGGRGUUAURGGUTGUTUURGUTGUTGUGGGAGAUUUAUTRGRGUTUUUTAAAA UUUAGAGGURGGGAUUURGGRGTGGGGAGAUAUTUUUUUUURGTAGUUUGUGAGGGU AUAGUURGRGGRGAGAUATRGAGAAGAGUUGURGAAGUTGGRGAGGUAGGAGUTGUU URGGTGUTGA |
| 215 | TTUUTURGAGGUUGUAGGGAGGGGGRGGTGRGGAAUGGAUGRGURGAGRGGGUAGRG UUAGUUTUTRGUUAUAUUUUUAGUAGGUAGURGUTUUURGTGURGGUATUUTRGU TGURGURGGUTUUUTRGGRGUUUURGGGUXGUUUUUAXGRGRGRGURGGGAUUTGUA RGAGUUUUUTRGTRGAUTRGGAGRGRGATUTGGGRGRGTGUUTUUUTGTUUTTGTUUTU TGUUUTRGTUTGGGARGTGTGUUURGUAUUUUUTGUAURGRGRGUTUUTUATUUUUTU URGUTUUU |
| 216 | GGGAGRGGGAGGGGTAGAGGAGRGRGRGGTGUAGGGGGGTGRGGGGUAUARGTUUUUA GARGAGAGUAGAGGAUAAGGAUAGGGAGGUARGRGUUUAGATRGRGUTURGAGTRGA RGAGGGGUTRGTGUAGGTUURGGRGRGRGXGTGGGGAGXGGUURGGGGGRGURGAGG GAGURGGRGGUAGRGAGGATGURGGUARGGGARGRGGGUUGTGGGGGTGTGAG RGAGAGGUTGAGRGUTGUURGUTRGGRGUAUUUATTURGUAURGUUUUUTUUUTGRGG GUUTRGGAGGAA |
| 217 | AAGGGGAGGGRGGGGURGAUURGGAUUUTTUAGGGAARGUUUTTGAGTAAUTRGRGUA UTTGGGAUUUATTUUUAUUTAGGAUUATAGGUUAAGATGGUUTGGTGGATGURGURG GUARGRGUUTUTUUTUTGRGGGGAAUXGAAGGRGUXGGTAGGTTTTUAUAUTTGUAGU RGATRGGUTAAGAGAAGRGGGATTUAGUGAGAAGUUAUTGGGAGUURGAGGAGRGG AGUAGAGGUAUUUAGGUAGUUTGRGRGGAGAAATRGGATRGGUTAGGARGGUUTGUA GUUUUTGRGRG |
| 218 | RGRGUAGGGGUTGUAGGURGUUUTAGURGAUURGATTTUTURGRGUAGGUTGUUTGGGT GUUTUTGUTURGUTUUTRGGGUTUUUAGTGGUUTUTRGGUTGAAUURGRGTTUTUTTA GURGATRGGUTGUAAGTGTGAAAAUUTAUXGGRGUUTTXGGTTUURGUUAGAGGAGAG GRGRGTGURGGRGGUAUUUAUUAGGUUAUUTTGAGUUTATGGUUTAGGTGGGAATGG GUUUUAAGTGRGRGAGUUAUTUAAGGGRGTUUUTGGAGGGTURGGGTRGGUUURGUU UUUUUTT |
| 219 | TGTGGRGGGGGUUTGGAGUTGUTGAGAGURGAGAGGRGUAGAGRGUAAGUTGGUAGGU TGGGUTGUTAUUURGGRGRGUAGATGUUURGURGRGUUAGTRGAGRGRGAAUAUTUTUR GGAAUATRGATUTATAUUTUUUTTTAAGGAUUXGGAUURGGGAAATTTUUATTTTUTGT |

TABLE 4-continued

Sequences Listed in Table 1

| SEQ ID NO: | Sequence |
|---|---|
| | TTTGGGAATAAGAAATAAAAGRGAUUAAGUTUTTGUUUTAATTTUUUUURGRGGGUUU<br>TTUUARGRGGGUTGGRGGGAUAGAAGGARGGGTURGAGUTRGGGGRGRGGGGTTUU<br>TGTGAAUTU |
| 220 | GAGTTUAUAGGAAUUURGRGUUUURGAGUTRGGAUURGTUUTTUTGATUURGUUAGUU<br>RGRGTGGAAGGGUURGRGGGGGGAAATTAGGGUAAGAGUUTGGTRGUTTTTATTTUTTA<br>TTUUUAAAAUAGAAAATGGAAATTTUURGGTUXGGGTUUTTAAAGGGAGGTGATAGAT<br>RGATGTTURGGAGAGATGTTRGRGUTRGAUTGGRGGRGGGGUATUTGRGRGURGGGATA<br>GUAGUUUAGUUTGUUAGUTTGRGUTUTGRGUUTUTRGGUTUTAGUAGUUUAAGUUU<br>URGUUAUA |
| 221 | UAGUUUTTGGUTTTUURGUTTUAGGUAAAATUTTUUUTUUTTUUTUTTTTTUTGGGGUU<br>TTUUUUARGAUUUUTUTTUUTAGUUUTTUTGATURGUUUUTGATGUATGAUTGGGGUU<br>AURGGAGGGGUTGAUUUTUURGGAGAGUUUXGTRGGTUUTGGTGGTUTTGGGAURGGA<br>GAGRGAUAGATGTGGAAAURGAGGUUUUTUAGTGAAGAGUTGUUAGGGTGGTRGUUTT<br>AGAGUAAAGGRGTTUUUTUATTURGUUTGRGUAGUTGUUUUTURGUURGGUTGURGUUU<br>UAGUURG |
| 222 | RGGGUTGGGGRGGUAGURGGGRGGAGGGGUAGUTGRGUAGGRGGAATGAGGAARGUU<br>TTTGUTUTAAGGRGAUUAUUUTGGUAGUTUTTUAUTGAGGGGUUTRGGTTTUUAUAUT<br>GTRGUTUTURGGTUUUAAGAUUAUUAGGAURGAXGGGGUTUTURGGGAGGGTUAGUUU<br>UTURGGTGGUUUUAGTUATGUATAGGGGARGGAUAGAAGGGUTAGGAAGAGGGGGTR<br>GTGGGGAAGGUUUUAGAAAAAAGAGGAAGGAGGGAAGATTTTGUUTGAAGRGGGAAA<br>GUUAAGGGUTG |
| 223 | GGGAAAGGGGGGAGAGGGAGAGGAGGRGRGGGGTGGGGGAGGGGAGTGAGUAGGGAG<br>URGGGAGAGGGAGGAGGGGRGGGAAUUAGGGGAGRGGUURGAAUUURGTTTGGTURG<br>GAUUURGUAGUUAURGUTGGGTUTRGURGURGGGTXGUUUTTRGRGTGGAGAUURGGT<br>URGRGUUUUUTUUURGGTUTUUTUUUUTUUUUTUUUUTURGUUUUUUTUUUTURGGUU<br>UAUAUAGUUTUTTUUAGAAAGAAGTUAUTUTAGAGURGRGRGAUUUAGUUUUAGAGTU<br>RGURGGGGTURG |
| 224 | RGGAUUURGGRGGAUTUTGGGGUTGGGTRGRGRGGUTUTAGAGTGAUTTUTTTUTGGAA<br>GAGGUTGTGTGGGURGGAGGGAGGGGGRGGAGGGGAGGGGAGGGGAGGAGAURGGG<br>GAGGGGGRGRGGAURGGATUTUUARGRGAAGGGXGAUURGGRGGRGAGAUUUAGRGG<br>TGGUTGRGGGGTURGGAUUAAARGGGGTTRGGGURGUTUUUUTGGTUUURGUUUUTUU<br>TUUUTUUURGGTUUUTGUTAUUUUUTUUUUAUUURGRGUUTUUTUTUUUTUTU<br>UUUUUTTTUUU |
| 225 | RGGTURGRGUUUUUTUUURGGTUTUUTUUUUTUUUUTUUUUTURGUUUUUUTUUUTUR<br>GGUUUAUAUAGUUTUTTUUAGAAAGAAGTUAUTUTAGAGURGRGRGAUUUAGUUUUA<br>GAGTURGURGGGGTURGUUUAURGGGTUTUUTGXGXGUUUUTUUURGUUUUTUUURGG<br>GUAUAGUUTUARGAAAUUTAAGGRGURGGUUARGRGUUAUUTUUUURGGGURGG<br>GGTUTUUTRGGTUUURGRGGGRGUTGGTUTUURGGGTGGGRGGUAGUUURGUUUT<br>GTGUUUTUUTGG |
| 226 | UUAGGAGGGUAUAGGGRGGGGUTGURGUUUAUURGGGAGAAUUAGRGUURGRGRGGG<br>GAURGAGGAGAUUURGGUURGGGGGAGGTGGRGRGTGGURGGRGGUUTTAGGTTTRGTG<br>AARGGGUTGTGUURGGGAGGGGRGGGAGGGGXGXGUAGGAGAUURGGTGGGRGGA<br>UUURGGRGGAUTUTGGGGUTGGGTRGRGRGGUTUTAGAGTGAUTTUTTTUTGGAAGAGG<br>UTGTGTGGGURGGAGGGAGGGGGRGGAGGGGAGGGGAGGGGAGGAGAURGGGGAGG<br>GGGRGRGGAURG |
| 227 | GRGGTRGGRGUUUUARGUTUUUTGAAGRGUUUUUAGGRGGUAUUAGTGURGGGUAGA<br>GTUUUUTRGGRGGURGRGGGRGTUAAATRGAUAUUTGAUTUUAUAGUTUUUTTUUUTU<br>TUUTUTTUTTUUAUUTUUURGGGGGTUUAGGUAUXGURGTGRGTUUAUTUURGGTUTUU<br>ARGGUTTAGGUAGARGGAGTGGGGGAUTURGGGGAUURGRGRGTUUTUTUUTUUTRGG<br>UUUTGGRGGGAGGAGURGGGUTGGGGTTTURGRGGGURGRGGRGRGTTTTAGGGUTGU<br>RGGGGAUTGU |
| 228 | GUAGTUUURGGUAGUUUAAAARGRGURGRGGGUURGRGGAAAUUUAGUURGGUTUUT<br>UURGUUAGGGURGAGGAGGAGAGGARGRGRGGGTUUURGGAGTUUUUUAUTURGTUTG<br>UUTAAGURGTGGAGAURGGGAGTGGARGUARGGXGGTGUUTGGAUUUURGGGGAGGTG<br>GAAGAAGAGGAGAGGGAAGGGAGUGTGGAGTUAGGTGTRGATTTGARGUURGRGGUR<br>GURGAGGGGAUUTGUURGGUAUTGGTGURGUUTGGGGGRGTTUAGGGAGRGTGGGG<br>RGURGAURGU |
| 229 | GUUUTUUTURGTGUTGGGUUTGUUUAUUUUUAGGGRGGAGGRGRGGGUTUTGRGTUR<br>GGAGGRGUUTRGGRGGUAGUTURGGTGGGURGRGTUTGGTGRGGGGUURGGGAUUU<br>AGUAGGGUAGUUXGGGATGGAGUUAGGRGGGAGUXGARGGAGURGUTUAUAUUURGU<br>XGURGGTGTRGURGRGUUTUTUUTTUURGGGGAUUAURGGGTUUUTGGRGGURGURGU<br>RGGURGUTGURGRGGUURGGGAAGUTGRGGUUUAUAGUAGTGGRGGRGGAGRGGRGGGT<br>GRGGGUUTGGU |

TABLE 4-continued

Sequences Listed in Table 1

| SEQ ID NO: | Sequence |
|---|---|
| 230 | GUUAGGUURGUAUURGURGUTURGURGUUAUTGUTGTAGGURGUAGUUUURGGGURG<br>RGGUAGRGGRGGRGGRGGURGUUAGGGAUURGGTGGTUUURGGGAAGGAGAAGRGRG<br>GRGAUAURGGXGGXGGGGTGTAAGRGGUURGTXGGUTUURGUUTGGUTUUAUUUXGG<br>GUTGUUUTGUTGGGTUURGGGUUURGUAUUAGARGRGGUUUUAURGGAGUTGURGUUR<br>GAGGRGUUTURGGARGUAGAGUURGRGUUTURGUUUTGGAGGUAGGAUAGGUUUAGU<br>ARGGAGGAGGGU |
| 231 | AGAAAAGUAGRGARGTGGRGTUAUUURGUTGUAGAAUTGGGAUUAUTRGGGUTRGGT<br>GUAGGGATTGGUTUUAGGUTTGURGTRGGGGTRGGGAGURGAGGARGAGGAGGRGGUR<br>GGGGGRGGUTGUTGUURGGARGGRGGRGGUTGUTXGRGUTGUTGUTGUTGRGURG<br>GGAGTGGRGGUTURGRGGGUTRGGGRGGUTURGGRGGRGTRGURGGUURGGGRGGRGG<br>RGGGGRGGGUTRGGUTGRGUTGUUTGRGUUTGGGUAGGGAGUAGRGGRGUTAUTUA<br>UTGTGGGAUT |
| 232 | AGTUUUAUAGTGAGTAGRGURGUTGUTUUUTGUUUAGGRGUAGGUAUAGRGUAGURGA<br>GUURGUUURGURGURGUURGGGURGGRGARGURGURGGAGURGUURGAGUURGRGGA<br>GURGUUAUUUURGGRGUAGUAGUAGUAGRGXGAGUAGURGURGURGTURGGGUA<br>GUAGURGUUUURGGURGUUTUUTRGTUUTRGGUUURGAUUURGARGGUAAGUUTGGA<br>GUUAAUUUUTGUAURGAGUURGAGTGGUURGAGUUUTGUAGRGGGGTGAAGRUUARGT<br>RGUTGUTTTTUT |
| 233 | GTGTGTGTGTGTGTGTGTGTGTGTGTGTGTGTGTGTGTGTAATGUATTTAGAG<br>GARGGGAGUTGUUTUTAGGGAGAAAGGGAGGGGGGAGGGGAAGAAAAAGGAAAG<br>AGRGRGTTTUUTRGURGGGGTTAURGGGGTGGXGRGGGUTTRGRGGURGAGGGGUTGUR<br>GGUURGGUURGUAGUTUUTRGRGGURGGUTGGGAAGTGGRGGGTURGGUTAGTURGRG<br>GGRGGGRGGAGRGRGURGTRGUTGUUAGTGTUUUUUTTTAAUATTUUTTUUURGAGUUT<br>TTUUUT |
| 234 | AGGGAAAGGUTRGGGGAAGGAATGTTAAAGGGGAUAUTGGUAGRGARGGRGRGUTUR<br>GUURGUURGRGGAUTAGURGGAUURGUUAUTTUUUAGURGGURGRGAGGAGUTGRGGG<br>URGGGURGGUAGUUUUTRGGURGRGAAGUURGXGUUAUUURGGTAAUUURGGRGAGG<br>AAARGRGUTUTTUUTTTTUTTUTUUUTUUUUUUTUUUTTTUTUUUTAGAGGUAGU<br>TUURGTUUTUTAAATGUATUAUAUAUAUAUAUAUAUAUAUAUAUAUAUAUAUAUA<br>UAUAUAUAUAU |
| 235 | UTUUTGGGRGAUUTAAAUUTRGATAAUTGUTGGAAAGGTUUAGUAGGAGAGGAGGGRG<br>AGGAGGGGRGGAGUUAGGAGGUURGGUUURGUUUAURGRGRGUURGUUTUTUTUTGU<br>AGAUUAURGGUTAGAGUAGGAGUARGAGUTUTTUXGUTGUTTUUAGGATUUUTGURGG<br>UTGGGUARGRGUUAAAAGUAGUUTGGGUUUTGGGTATRGRGUTTGGGGGGAGGGTAU<br>UUURGURGUTGGGUARGRGUUAAGAGUAGUUUTGGGUUUTGGGTATRGTGUTTAGGG<br>GGAGGGTATRG |
| 236 | RGATAUUUTUUUUTAAGUARGATAUUUTAGGGUUUAGGGUTGUTUTTGGRGRGTGUUU<br>AGURGGRGGGGTAUUUTUUUUUAAGRGRGATAUUUAGGGUUUAGGGUTGUTTTTGG<br>RGRGTGUUUAGURGGUAGGGATUUTGGAAAUAGXGGAAGAGUTRGTGUTUUTGUTUTA<br>GURGGTGGTUTGUAGAGAGGRGGGRGRGRGGTGGGRGGGGURGGGUUTUUTGGUTU<br>RGUUUUTUUTRGUUUTUUTUTUTUUTGUTGGAUUTTUUAGUAGTTATRGAAGTTTAGGTR<br>GUUUAGGAG |
| 237 | GGRGURGGGRGUTGGGUUTAUAGUAGAGURGRGGGURGRGGGGTRGGAAAGTUUTTUR<br>GGGGRGGGGURGUAGRGGUUTUTTUURGUAGUUUUTRGGGUURGGGUUURGGTGGAAR<br>GGAAAUUTUUUUUTAUUURGGGAGGGGUTGUUAGXGGGUTGGGGGTGRGAAAARGGR<br>GGUAGGAGRGGGRGAGGGGUURGGGURGRGUAUTTTGRGUUTGGGTTTGRGRGURGRG<br>GURGRGGGAGTUURGRGRGGAURGGURGGARGUURGGUUTUUUUAGUUUUAGUTTTT<br>TGTGTGTGTGT |
| 238 | AUAUAUAUAUAAAAGUTGGGGUTGGGGGAGGURGGGRGTURGGURGGTURGRGRGG<br>GAUUURGRGGURGRGGRGRGUAAAUUUAGGRGUAAAGTGRGRGGUURGGGUUUUTRG<br>UURGUTUUTGURGURGTTTTRGUAUUUUUAGUUXGUTGGUAGUUUUTUURGGGGTAGG<br>GGGAGGTTTURGTTUUAURGGGGUURGGGUURGAGGGGUTGRGGGAAGAGGURGUTGR<br>GGUUURGUUURGGAAGGAUTTTURGAUUURGRGGUURGRGGUTUTGUTGTAAGUUUAG<br>RGUURGGRGUU |
| 239 | AGGUAUAGAAAGGRGUAGURGUTAGUUAGAGUURGUAUAGAGUUAGAGUUAGGTUUU<br>UAUTGGRGUAGATGGGGAUTGUAGGUAUAGUAGTAGUUARGRGGGTGTAAARGTAGA<br>GURGRGTGAAUUUGGGTTGTGGGAUUUAGGGUUUXGAUUAGUUUUUATUUUURGGUTGG<br>UAUUTRGGTUURGGGGAGTUTAGUTTUUUTTTUTGUAGAATGGGUTGGAGGRGUUUU<br>UUAUAGGUURGUUUAGGRGUUUUURGGGGUUAGRGUUUUTUUUUUAUUTGUUURGUU<br>UUUAUUURGRGGG |
| 240 | UURGRGGGTGGGGRGGGGUAGGTGGGGGAGGGGRGUTGGUUURGGGGGRGUUTGG<br>GRGGGUUTGTGGGGGGRGUUTUUAGUUUUATTUTGUAGAAAGGGAAGUTGAGAUTUUUR<br>GGGAUGRAGAUTGUUAGURGGGGATGGGGGUTGGTXGGGGUUTGGGAUUUUAUAAUUR<br>GGGTTUARGRGGUTUTARGUTTUAUAUURGRGTGGUTAUTGUTGUGUUTGUAGTUUUUUA |

TABLE 4-continued

Sequences Listed in Table 1

| SEQ ID NO: | Sequence |
|---|---|
| | TUTGRGUUAGTGGGGAUUTGGUTUTGGUTUTGTGRGGGUTUTGGUTAGRGGUTGRGUUTTTUTGTGUUT |
| 241 | GGGGURGRGGAGTRGGGTGAGGRGGRGGRGGUTGRGGRGGTGGGGURGGGRGAGGTURGUTGRGGTUURGGRGGUTURGTGGUTGUTURGUTUTGAGRGUUTGGRGRGUUURGRGUUUTUUUTGURGGGGURGUTGGGURGGGGATGUAXGRGGGGUURGGGAGUUATGGTURGUTTRGGGGARGAGUTGGGRGGURGUTATGGGGGUUURGGRGGRGGAGAGRGGGUURGGGGRGGRGGGGURGGRGGGGRGGGGGGUURGGGTUURGGGGGGUTGUAGUURGGUUAGRGGGTUUTUTA |
| 242 | TAGAGGAUURGUTGGURGGGUTGUAGUUUUURGGGAUURGGGUUUUURGUUURGURGGUUURGURGUUURGGGURGUTUTURGURGURGGGGUUUUUATAGRGGURGUUUAGUTRGTUUURGAAGRGGAUUATGGUTUURGGGUUURGXGTGUATUUURGGUUUAGRGGUUURGGUAGGGAGGGRGRGGGGRGRGUUAGGRGUTUAGAGRGGAGUAGUUARGGAGURGURGGGAURGUAGRGGAUUTRGUURGGUUUUAURGURGUAGURGURGURGUUTAUURGAUTURGRGGUUUU |

Compositions for Detecting Methylation

Also provided herein are probes and primers that are complementary to one or more of SEQ ID NOS: 1-242. In embodiments, pairs of primers complementary to nucleotide sequences on either side of a methylation site of interest listed in Table 1 are provided. In embodiments, a plurality of probes and/or primers are provided to detect and/or amplify a polynucleotide (e.g., a polynucleotide obtained by bisulfite treatment of DNA) comprising a methylation site of interest. In embodiments, a probe or primer is complementary to a polynucleotide sequence that encompasses the methylation site of interest. In embodiments, the probe or primer is complementary to a sequence that is proximal to the methylation site of interest (e.g., within 1000, 900, 800, 700, 600, 500, 400, 300, 200, 100, 75, 50, or 25 nucleotides of the methylation site of interest in a genomic or bisulfite-treatment-derived polynucleotide).

In embodiments, a deoxyribonucleic acid selected from SEQ ID NO:243 to SEQ ID NO:356 is included. In embodiments, the deoxyribonucleic acid selected from SEQ ID NO:243 to SEQ ID NO:356 is hybridized to a complementary DNA sequence having uridine or cytosine. In embodiments, each of the nucleic acids is different. In embodiments, each of the nucleic acids does not simultaneously have the same sequence selected from SEQ ID NO:243 to SEQ ID NO:356. SEQ ID NOS: 243 to 356 are listed in Table 5 below.

TABLE 5

SEQ ID NOS: 243 to 356

| SEQ ID NO: | Sequence |
|---|---|
| 243 | GTTTTTTTTTAAAGTAGTTTTT |
| 244 | CTCCTACAACCCCCTTCC |
| 245 | TTTTGAGTAGTTGGAGTTATAG |
| 246 | TAAATTCATCCTCTACCTATTA |
| 247 | ATGGTATGAATTAATTAATTTGA |
| 248 | CTCCCTAAAAAAAAAATAAA |
| 249 | TATTTGTTTGATTTTAATTATATTT |
| 250 | AAACTCTACTCTCTAAACCTTTC |

TABLE 5-continued

SEQ ID NOS: 243 to 356

| SEQ ID NO: | Sequence |
|---|---|
| 251 | ATTTTATTGATTATGTTTAGTTGATTA |
| 252 | AAAAATACCCCAAAAACAA |
| 253 | GTGGAAGGGAAAAAAAAGAG |
| 254 | ACAAACTCCCCTATACCTCAAATA |
| 255 | TTTTTTAAATGGTGAAATAT |
| 256 | AATTTTACTTCTTCTTCTTATC |
| 257 | TGGTAATAATTGGAGGAATTG |
| 258 | ACAAATAAAATCATAAAAAATAACAAAC |
| 259 | GATTTTTTGATTTGAAAATAGTT |
| 260 | AATCTCAACCCCAAACTC |
| 261 | TTAGGTAAAGATTTGGTTTTAGAA |
| 262 | AACTTATTATATAAATTATAAAAAAATAAA |
| 263 | GGAGGTGTTTTTTAGTAAGTTTG |
| 264 | CCTCATACCTATAACCTACACTCA |
| 265 | AAGGGTTGTTATGTTAGTGTAGT |
| 266 | CCCAAAAATAAATAATTTAACTA |
| 267 | ATTTTTGTTTTAATATGGAGTTG |
| 268 | AAACCTAAATCTACACTTAAACATC |
| 269 | AGGGTTAGGGTTTTTTTG |
| 270 | AAATCTCTTTATTACTCATTTTCTATA |
| 271 | GTTATTTATATTTTTGAGTATTAAGAGTT |
| 272 | ACCAACAAATACAACACCTTCT |
| 273 | GGTTTTTTAGTTTTATGAATTATTTA |
| 274 | AACCCCTCTACAACCTACTAC |

TABLE 5-continued

SEQ ID NOS: 243 to 356

| SEQ ID NO: | Sequence |
|---|---|
| 275 | GATGAGGAAGTTGAGGTATAG |
| 276 | CTCCAACCCATTCTACAA |
| 277 | GAGGGGATTGAGTAGGTGAATAG |
| 278 | CAAAACAAAAAAAAAATAAAAAAAAACT |
| 279 | AAGGAGAGGAGAAGAGGTATAG |
| 280 | AATAATAAAAAAAAACTAAATTCAAAC |
| 281 | TTGGGGTTTAGGGATTTAG |
| 282 | AATAAATATACCTCCTTTCAAACTAA |
| 283 | AAAGGTTAAATTAAAAATTTTTTAT |
| 284 | CTCCCAACTATACTTCTTAATCTC |
| 285 | GGTTTAGAGTTATTGAATAAATGAAGTG |
| 286 | CAAAATCAAATTCTCCAACAAA |
| 287 | TGATGGAGGAAGTTTTG |
| 288 | AACCCTAAACTAAACAACCC |
| 289 | TTAAGGATTTAGATATTTGTAAT |
| 290 | AATAAATTTATAAATTTACTCTCTTAC |
| 291 | AATGTTTTGGAGATTAGTAATAT |
| 292 | TCTTCCTAAAAAAAAAATAAA |
| 293 | GGGAATAATGAGGAGGAGA |
| 294 | AAAAATACAATAAAAAATCTTAAATAAA |
| 295 | GGTAGGGATTGGGATAG |
| 296 | AACAAACAAAACTATAAAATTAAACTAA |
| 297 | GGTTAGGAGATTAGGGATTG |
| 298 | AAAAAAAAAAACAACTTAAAAAAC |
| 299 | TGTTTATTTTAGAGGTGTTTATTT |
| 300 | ACCCTAATCCAATATCCC |
| 301 | GGTTGGTTAGGTTGTTATTT |
| 302 | CAAACACCACATACTTATTC |
| 303 | TTTGGGTTTAGAAAGTTG |
| 304 | CAAAACTAAAAAAAAAATAAC |
| 305 | TTTTGAGTTTGGTTTAGTT |
| 306 | CCTAAAAAAAATAAAAATCC |
| 307 | GGAATTTGGAGGGTAAAA |
| 308 | CTAATCTCTATCCTATATATTTCTTTATATT |
| 309 | TATTATATTGTTATGTTGATT |
| 310 | ATATTAATTTCTTCCAACTAA |
| 311 | TGGGATTGGTAAGTAGGTATT |
| 312 | AAAAAAAAAAACCTATAACCTATAAA |
| 313 | ATGGTTTTGTTTGTAGAC |
| 314 | ATTATTATTATTTATTTATTATCA |
| 315 | TTTTTTTGAAAGTTAGTGAATTTATTTATT |
| 316 | ACCCATCTCCCCACACAC |
| 317 | TTGGGGTTTAAAGGTATTAG |
| 318 | AAAACAAAAACTACTAAAAAAAAAT |
| 319 | TTGGTTAAGGAAGAAAGGAGTAG |
| 320 | CACCCCCTTCAAAAAAAA |
| 321 | TGGGGTTTTTTGGTTTTTT |
| 322 | CCACCTCACAAACACACAC |
| 323 | AGAAAGGTATTGTTTTAGTAAA |
| 324 | TTACAAAATAAAACCAACCTAT |
| 325 | GAGTTTTTTTTTTATTTAGTTTT |
| 326 | CCTACCCCTAATATCTACA |
| 327 | TTTTTTTAATATTTGTGAATTAT |
| 328 | AAACAACAACCCTAACTATC |
| 329 | ATGGAAGTTGGAGTTGAGAAG |
| 330 | ACACCTAAAACAAAATAAAAAAATC |
| 331 | ATTAGTTTTAGTTTTTAGTATT |
| 332 | TCCCCTTAACATTAAATC |
| 333 | TTGAGATTAGATTAGAGTTTATTT |
| 334 | AAAAAAACCTTAATCCTATAAT |
| 335 | TTTTTAGTAGGGTTAAGAGGATTT |
| 336 | TCCAATACACACCACCAA |
| 337 | TTTGAATGGTAGAGGAAATAGTT |
| 338 | ACCCAAAAATTCTATCTTTCAC |
| 339 | TTTATGGGTTTTTATTTTAGTA |
| 340 | AAAAATATTCCAATATAAACAAA |
| 341 | AGAGTTGTTGTTGTTTTTATGT |
| 342 | CAACCCAAAATCCTTAACTATA |
| 343 | AAAAGAATTAGGGTAGGTATAGT |
| 344 | CTTAATCAATAATCTCCAAATAT |
| 345 | TTTGGTTATGGAGGTATAGT |
| 346 | AAAAAAAAAATAAATAATAC |
| 347 | ATTTTATTTGGGGATTTTTAATA |
| 348 | TAAAACAAAATTAACAACAATTAAC |
| 349 | TAAGATGGTTTGGTGGATGT |
| 350 | AAATCTCTCACTCACCCTTTC |

TABLE 5-continued

SEQ ID NOS: 243 to 356

| SEQ ID NO: | Sequence |
|---|---|
| 351 | GGTTTGGAGTTGTTGAGAG |
| 352 | AAAAAAATTAAAACAAAAACTTAATC |
| 353 | ATTTTTTTTTTAGTTTTTTTGAT |
| 354 | CACCCTAACAACTCTTCACT |
| 355 | GGGGAGAAGAAAAAGGAAAG |
| 356 | AAAAAAAATATTAAAAAAAAACACTAACA |

In embodiments, aspects include a deoxyribonucleic acid selected from SEQ ID NO:243 to SEQ ID NO:356, hybridized to corresponding a complementary DNA sequence having uridine or cytosine, and in a complex with an enzyme, e.g., a thermostable DNA polymerase. In embodiments, the thermostable DNA polymerase is Taq DNA polymerase.

In some aspects, the method includes deoxyribonucleic acid that has a sequence that is at least 50%-55%, 55%-60%, 60%-65%, 65%-70%, 70%-75%, 75%-80%, 80%-85%, 90%, 91%, 92%, 93%, 94%, 95%, 96%, 97%, 98%, 99% or more identical or homologous to a nucleic acid having a sequence of at least one of SEQ ID NO:243 to SEQ ID NO:356.

Kit for Detecting Methylation Level of a DCIS Cell Mass

Also provided is a kit including a plurality (e.g., at least about 10, 20, 40, 50, 100, 110 or 118) nucleic acids each independently comprising one sequence selected from SEQ ID NO:243 to SEQ ID NO:356, in which the nucleic acids do not simultaneously include the same sequence.

In some aspects, the kit includes deoxyribonucleic acid that has a sequence that is at least 50%-55%, 55%-60%, 60%-65%, 65%-70%, 70%-75%, 75%-80%, 80%-85%, 90%, 91%, 92%, 93%, 94%, 95%, 96%, 97%, 98%, 99% or more identical or homologous to a nucleic acid having a sequence of at least one of SEQ ID NO:243 to SEQ ID NO:356.

The kit provided herein may include enzymes, reagents for deamination of cytosine, buffers, vials, control DNA, devices for collecting DCIS tissue samples, reagents for isolating DNA, reagents for labeling DNA, labels, or any combinations thereof.

The kit provided herein may include enzymes such as thermostable DNA polymerase enzymes, restriction enzymes, and combination thereof.

In embodiments, the kit(s) may further include enzymes, reagents for deamination of cytosine, buffers, vials, control DNA, devices for tissue samples, or reagents for labeling DNA, or any combinations thereof.

In embodiments, a kit provided herein may include a solid carrier capable of adsorbing the nucleic acids containing in a sample of a body fluid, for example blood (whole blood, plasma, or serum). The kit may also contain other components for example, reagents, in concentrated or final dilution form, chromatographic materials for the separation of the nucleic acids, aqueous solutions (buffers, optionally also in concentrated form for final adjusting by the user) or chromatographic materials for desalting nucleic acids which have been eluted with sodium chloride.

In embodiments, a kit provided herein includes materials for purifying nucleic acids, for example, inorganic and/or organic carriers and optionally solutions, excipients and/or accessories. Such agents are known and are commercially available. For solid phase nucleic acid isolation methods, many solid supports have been used including membrane filters, magnetic beads, metal oxides, and latex particles.

In addition, a kit can also contain excipients such as, for example, a protease such as proteinase K, or enzymes and other agents for manipulating nucleic acids, e.g., at least one amplification primer, nucleic acid bases (A, T, G, C, and/or U), and enzymes suitable for amplifying nucleic acids, e.g., DNase, a nucleic acid polymerase and/or at least one restriction endonuclease. Alternatively, a commercial polymerase chain reaction kit may be used to amplify the DNA samples.

Exemplary Techniques for Detecting Specific Sequences

Specific sequences, such as the sequences listed in Table 1 (or portions thereof containing a methylation site of interest), can be detected by numerous methods that are well-established in the art (e.g., PCR-based sequence specific amplification, isozyme markers, northern analysis, sequence specific hybridization, and array based hybridization). In embodiments, the presence or absence of methylation is determined through nucleotide sequencing of the site of interest (e.g., the site in bisulfate-treated DNA or an amplicon thereof). Any of these methods are readily adapted to high throughput analysis.

Some techniques for detecting specific sequences utilize hybridization of a probe nucleic acid to nucleic acids corresponding to the methylation site of interest (e.g., amplified nucleic acids produced using bisulfate-treated DNA as a template or the bisulfate-treated DNA itself). Hybridization formats, including, but not limited to: solution phase, solid phase, mixed phase, or in situ hybridization assays are useful for sequence detection. A non-limiting guide to the hybridization of nucleic acids is found in Tijssen (1993) Laboratory Techniques in Biochemistry and Molecular Biology—Hybridization with Nucleic Acid Probes Elsevier, N.Y., as well as in Sambrook, Berger and Ausubel.

Nucleic acid probes complementary to a methylation site can be cloned and/or synthesized. Any suitable label can be used with a probe. Detectable labels suitable for use with nucleic acid probes include, for example, any composition detectable by spectroscopic, radioisotopic, photochemical, biochemical, immunochemical, electrical, optical or chemical means. Useful labels include biotin for staining with labeled streptavidin conjugate, magnetic beads, fluorescent dyes, radiolabels, enzymes, and colorimetric labels. Other labels include ligands which bind to antibodies labeled with fluorophores, chemiluminescent agents, and enzymes. A probe can also constitute radiolabelled PCR primers that are used to generate a radiolabelled amplicon. Labeling strategies for labeling nucleic acids and corresponding detection strategies can be found, e.g., in Haugland (2003) Handbook of Probes and Research Chemicals Ninth Edition by Molecular Probes, Inc. (Eugene Oreg.). Additional non-limiting details regarding sequence detection strategies are found below.

PCR, RT-PCR and LCR are in particularly broad use as amplification and amplification-detection methods for amplifying nucleic acids (e.g., those comprising a methylation site), facilitating detection of the nucleic acids of interest.

In embodiments, real time PCR or LCR is performed on the amplification mixtures described herein, e.g., using molecular beacons or TaqMan™ probes. A molecular beacon (MB) is an oligonucleotide or peptide nucleic acid (PNA) which, under appropriate hybridization conditions, self-hybridizes to form a stem and loop structure. The MB has a label and a quencher at the termini of the oligonucleotide or PNA; thus, under conditions that permit intramolecular hybridization, the label is typically quenched (or at least altered in its fluorescence) by the quencher. Under conditions where the MB does not display intra-molecular hybridization (e.g., when bound to a target nucleic acid, e.g., to a region of an amplicon during amplification), the MB label is unquenched. Details regarding standard methods of making and using MBs are well established in the literature and MBs are available from a number of commercial reagent sources. See also, e.g., Leone et al. (1995) "Molecular beacon probes combined with amplification by NASBA enable homogenous real-time detection of RNA." Nucleic Acids Res. 26:2150-2155; Tyagi and Kramer (1996) "Molecular beacons: probes that fluoresce upon hybridization" Nature Biotechnology 14:303-308; Blok and Kramer (1997) "Amplifiable hybridization probes containing a molecular switch" Mol Cell Probes 11:187-194; Hsuih et al. (1997) "Novel, ligation-dependent PCR assay for detection of hepatitis C in serum" J Clin Microbiol 34:501-507; Kostrikis et al. (1998) "Molecular beacons: spectral genotyping of human alleles" Science 279:1228-1229; Sokol et al. (1998) "Real time detection of DNA:RNA hybridization in living cells" Proc. Natl. Acad. Sci. U.S.A. 95:11538-11543; Tyagi et al. (1998) "Multicolor molecular beacons for allele discrimination" Nature Biotechnology 16:49-53; Bonnet et al. (1999) "Thermodynamic basis of the chemical specificity of structured DNA probes" Proc. Natl. Acad. Sci. U.S.A. 96:6171-6176; Fang et al. (1999) "Designing a novel molecular beacon for surface-immobilized DNA hybridization studies" J. Am. Chem. Soc. 121:2921-2922; Marras et al. (1999) "Multiplex detection of single-nucleotide variation using molecular beacons" Genet. Anal. Biomol. Eng. 14:151-156; and Vet et al. (1999) "Multiplex detection of four pathogenic retroviruses using molecular beacons" Proc. Natl. Acad. Sci. U.S.A. 96:6394-6399. Additional details regarding MB construction and use is found in the patent literature, e.g., U.S. Pat. No. 5,925,517 (Jul. 20, 1999) to Tyagi et al. entitled "Detectably labeled dual conformation oligonucleotide probes, assays and kits;" U.S. Pat. No. 6,150,097 to Tyagi et al (Nov. 21, 2000) entitled "Nucleic acid detection probes having non-FRET fluorescence quenching and kits and assays including such probes" and U.S. Pat. No. 6,037,130 to Tyagi et al (Mar. 14, 2000), entitled "Wavelength-shifting probes and primers and their use in assays and kits."

PCR detection and quantification using dual-labeled fluorogenic oligonucleotide probes, commonly referred to as "TaqMan™" probes, can also be performed. These probes are composed of short (e.g., 20-25 base) oligodeoxynucleotides that are labeled with two different fluorescent dyes. On the 5' terminus of each probe is a reporter dye, and on the 3' terminus of each probe a quenching dye is found. The oligonucleotide probe sequence is complementary to an internal target sequence present in a PCR amplicon. When the probe is intact, energy transfer occurs between the two fluorophores and emission from the reporter is quenched by the quencher by FRET. During the extension phase of PCR, the probe is cleaved by 5' nuclease activity of the polymerase used in the reaction, thereby releasing the reporter from the oligonucleotide-quencher and producing an increase in reporter emission intensity. Accordingly, TaqMan™ probes are oligonucleotides that have a label and a quencher, where the label is released during amplification by the exonuclease action of the polymerase used in amplification. This provides a real time measure of amplification during synthesis. A variety of TaqMan™ reagents are commercially available, e.g., from Applied Biosystems (Division Headquarters in Foster City, Calif.) as well as from a variety of specialty vendors such as Biosearch Technologies (e.g., black hole quencher probes). Further details regarding dual-label probe strategies can be found, e.g., in WO92/02638.

Other similar methods include e.g. fluorescence resonance energy transfer between two adjacently hybridized probes, e.g., using the "LightCycler™" format described in U.S. Pat. No. 6,174,670.

Amplification and Sequencing Primers

In embodiments, methylation sites are detected using primers, e.g., to amplify and/or sequence polynucleotides comprising the methylation sites.

Suitable primers can be designed and is not intended that the present subject matter be limited to any particular primer or primer pair. For example, primers can be designed using any suitable software program, such as LASERGENE™, e.g., taking account of publicly available sequence information. Flanking sequences for the methylation sites identified herein are publicly available; accordingly, suitable amplification primers can be constructed based on well understood base-pairing rules. The sequence of any amplicon can be detected as has already been discussed above, e.g., by sequencing, hybridization, array hybridization, PCR, LCR, or the like.

In embodiments, the primers are radiolabelled, or labeled by any suitable means (e.g., using a non-radioactive fluorescent tag), to allow for rapid visualization of differently sized amplicons following an amplification reaction without any additional labeling step or visualization step. In embodiments, the primers are not labeled, and the amplicons are visualized following their size resolution, e.g., following agarose or acrylamide gel electrophoresis. In embodiments, ethidium bromide staining of the PCR amplicons following size resolution allows visualization of the different size amplicons.

It is not intended that the primers be limited to generating an amplicon of any particular size. The primers can generate an amplicon of any suitable length for detection (e.g., by sequencing or hybridization). In embodiments, amplification produces an amplicon at least 20 nucleotides in length, or alternatively, at least 50 nucleotides in length, or alternatively, at least 100 nucleotides in length, or alternatively, at least 200 nucleotides in length. Amplicons of any size can be detected and/or sequenced using various technologies described herein and known in the art.

Detection of Methylation Levels Using Sequencing

Sequencing is the process of determining the precise order of nucleotides within a DNA molecule. The advent of rapid DNA sequencing methods has greatly accelerated biological and medical research and discovery. Non-limiting examples and descriptions are provided below. However, embodiments are not limited to the use of a particular sequencing assay, technology, or approach.

Sanger sequencing is a method of DNA sequencing based on the selective incorporation of chain-terminating dideoxynucleotides by DNA polymerase during in vitro DNA replication (Sanger F; Coulson A R (May 1975) J. Mol. Biol. 94 (3): 441-8; Sanger et al. (December 1977) Proc. Natl. Acad. Sci. U.S.A. 74 (12): 5463-7).

In embodiments, next-generation sequencing is used. Non-limiting examples of next-generation sequencing methods include massively parallel signature sequencing (MPSS), single-molecule real-time sequencing, ion semiconductor sequencing, pyrosequencing, sequencing by synthesis, sequencing by ligation, chain termination, DNA nanoball sequencing, helicos single molecule sequencing, single molecule real time sequencing, nanopore DNA sequencing, tunnelling currents DNA sequencing, and sequencing by hybridization.

Many commercially available sequencing technologies, devices, and services are available. In embodiments, an Illumina sequencer is used. In embodiments, PCR products are ligated with a linker and sequenced using a high throughput sequencer, such as an Illumina sequencer. In embodiments, the ligation step can be avoided, omitted, or eliminated by adding a linker to amplification primers.

Array-Based Sequence Detection

Array-based detection can be performed using commercially available arrays, e.g., from Affymetrix (Santa Clara, Calif.) or other manufacturers. Reviews regarding the operation of nucleic acid arrays include Sapolsky et al. (1999) "High-throughput polymorphism screening and genotyping with high-density oligonucleotide arrays." Genetic Analysis: Biomolecular Engineering 14:187-192; Lockhart (1998) "Mutant yeast on drugs" Nature Medicine 4:1235-1236; Fodor (1997) "Genes, Chips and the Human Genome." FASEB Journal 11:A879; Fodor (1997) "Massively Parallel Genomics." Science 277: 393-395; and Chee et al. (1996) "Accessing Genetic Information with High-Density DNA Arrays." Science 274:610-614.

A variety of probe arrays have been described in the literature and can be used for detection of methylation. For example, DNA probe array chips or larger DNA probe array wafers (from which individual chips would otherwise be obtained by breaking up the wafer) may be used in embodiments described herein. DNA probe array wafers generally comprise glass wafers on which high density arrays of DNA probes (short segments of DNA) have been placed. Each of these wafers can hold, for example, approximately 60 million DNA probes that are used to recognize longer sample DNA sequences (e.g., from individuals or populations, e.g., that comprise methylation sites of interest). The recognition of sample DNA by the set of DNA probes on the glass wafer takes place through DNA hybridization. When a DNA sample hybridizes with an array of DNA probes, the sample binds to those probes that are complementary to the sample DNA sequence. By evaluating to which probes the sample DNA for an individual hybridizes more strongly, it is possible to determine whether a known sequence of nucleic acid is present or not in the sample, thereby determining whether a uracil, thymine, or cytosine is present at a polynucleotide site corresponding to a genomic methylation site. One can also use this approach to control the hybridization conditions to permit single nucleotide discrimination, e.g., for the identification of methylation at a site of interest. Arrays provide one convenient embodiment for detecting multiple methylation sites simultaneously (or in series). Of course, any detection technology (PCR, LCR, and/or sequencing etc.) can similarly be used, e.g., with multiplex amplification/detection/sequencing reactions, or simply by running several separate reactions, e.g., simultaneously or in series.

In embodiments, the use of DNA probe arrays to obtain methylation information involves the following general steps: design and manufacture of DNA probe arrays, preparation of the sample, bisulfate treatment, hybridization of sample DNA to the array, detection of hybridization events and data analysis to determine sequence. In embodiments, an array is used to capture polynucleotides containing a methylation site of interest, and the captured polynucleotides are subsequently amplified and/or sequenced. Preferred wafers are manufactured using a process adapted from semiconductor manufacturing to achieve cost effectiveness and high quality, and are available, e.g., from Affymetrix, Inc. of Santa Clara, Calif.

For example, probe arrays can be manufactured by light-directed chemical synthesis processes, which combine solid-phase chemical synthesis with photolithographic fabrication techniques as employed in the semiconductor industry. Using a series of photolithographic masks to define chip exposure sites, followed by specific chemical synthesis steps, the process constructs high-density arrays of oligonucleotides, with each probe in a predefined position in the array. Multiple probe arrays can be synthesized simultaneously on a large glass wafer. This parallel process enhances reproducibility and helps achieve economies of scale.

In embodiments, DNA probe arrays can be used to obtain data regarding presence of sequences (e.g., corresponding to methylated or unmethylated DNA) of interest. The DNA samples may be tagged with biotin and/or a fluorescent reporter group by standard biochemical methods. The labeled samples are incubated with an array, and segments of the samples bind, or hybridize, with complementary sequences on the array. The array can be washed and/or stained to produce a hybridization pattern. The array is then scanned and the patterns of hybridization are detected by emission of light from the fluorescent reporter groups. Because the identity and position of each probe on the array is known, the nature of the DNA sequences in the sample applied to the array can be determined.

In embodiments, the nucleic acid sample to be analyzed is isolated, bisulfate-treated, amplified and, optionally, labeled with biotin and/or a fluorescent reporter group. The labeled nucleic acid sample may then be incubated with the array using a fluidics station and hybridization oven. The array can be washed and or stained or counter-stained, as appropriate to the detection method. After hybridization, washing and staining, the array is inserted into a scanner, where patterns of hybridization are detected. The hybridization data are collected as light emitted from the fluorescent reporter groups already incorporated into the labeled nucleic acid, which is now bound to the probe array. Probes that most clearly match the labeled nucleic acid produce stronger signals than those that have mismatches. Since the sequence and position of each probe on the array are known, by complementarity, the identity of the nucleic acid sample applied to the probe array can be identified. In embodiments, hybridization techniques and conditions that allow only fully complementary nucleotide sequences to hybridize with probes in an array are used.

Prior to amplification and/or detection of a nucleic acid comprising a sequence of interest, the nucleic acid is optionally purified from the samples by any available method, e.g., those taught in Berger and Kimmel, Guide to Molecular Cloning Techniques, Methods in Enzymology volume 152 Academic Press, Inc., San Diego, Calif. (Berger); Sambrook et al., Molecular Cloning—A Laboratory Manual (3rd Ed.), Vol. 1-3, Cold Spring Harbor Laboratory, Cold Spring Harbor, N.Y., 2001 ("Sambrook"); and/or Current Protocols in Molecular Biology, F. M. Ausubel et al., eds., Current Protocols, a joint venture between Greene Publishing Associates, Inc. and John Wiley & Sons, Inc., (supplemented through 2002) ("Ausubel")). A plethora of kits are also commercially available for the purification of nucleic acids from cells or other samples (see, e.g., EasyPrep™, FlexiPrep™, both from Pharmacia Biotech; StrataClean™, from Stratagene; and, QIAprep™ from Qiagen). Alternately, samples can simply be directly subjected to amplification or detection, e.g., following aliquotting and/or dilution.

Breast Cancer Diagnostic System and Processes

In embodiments, included herein is a system for detecting methylation or unmethylation of a DCIS cancer cell proliferation DNA molecule of a subject. In embodiments, the system provides at least one processor; and at least one memory including program code which when executed by the at least one processor provides operations comprising: contacting an isolated DCIS cancer cell proliferation DNA molecule from the subject with a bisulfite salt thereby forming a reacted DCIS cancer cell proliferation DNA molecule; detecting the presence or absence of uracil in the reacted DCIS cancer cell proliferation DNA molecule at a methylation site set forth in Table 1, thereby detecting methylation or unmethylation of the DCIS cancer cell proliferation DNA molecule of the subject; generating a diagnosis for the subject based at least in part on the presence or absence of uracil in the reacted DCIS cancer cell proliferation DNA molecule at the methylation site set forth in Table 1; and providing, via a user interface, the diagnosis or prognosis for the subject. In embodiments, the system provides at least one processor; and at least one memory including program code which when executed by the at least one processor provides operations comprising: contacting the plurality of isolated DCIS cancer cell proliferation DNA molecules with a bisulfite salt thereby forming a plurality of reacted DCIS cancer cell proliferation DNA molecules; detecting the level of reacted DCIS cancer cell proliferation DNA molecules in the plurality of reacted DCIS cancer cell proliferation DNA molecules having a uracil at a methylation site set forth in Table 1 thereby detecting the level of methylation or unmethylation in the plurality of DCIS cancer cell proliferation DNA molecules of the subject; generating a diagnosis for the subject based at least in part on the level of methylation or unmethylation at the plurality of methylation sites set forth in Table 1; and providing, via a user interface, the diagnosis or prognosis for the subject.

Figure 2:
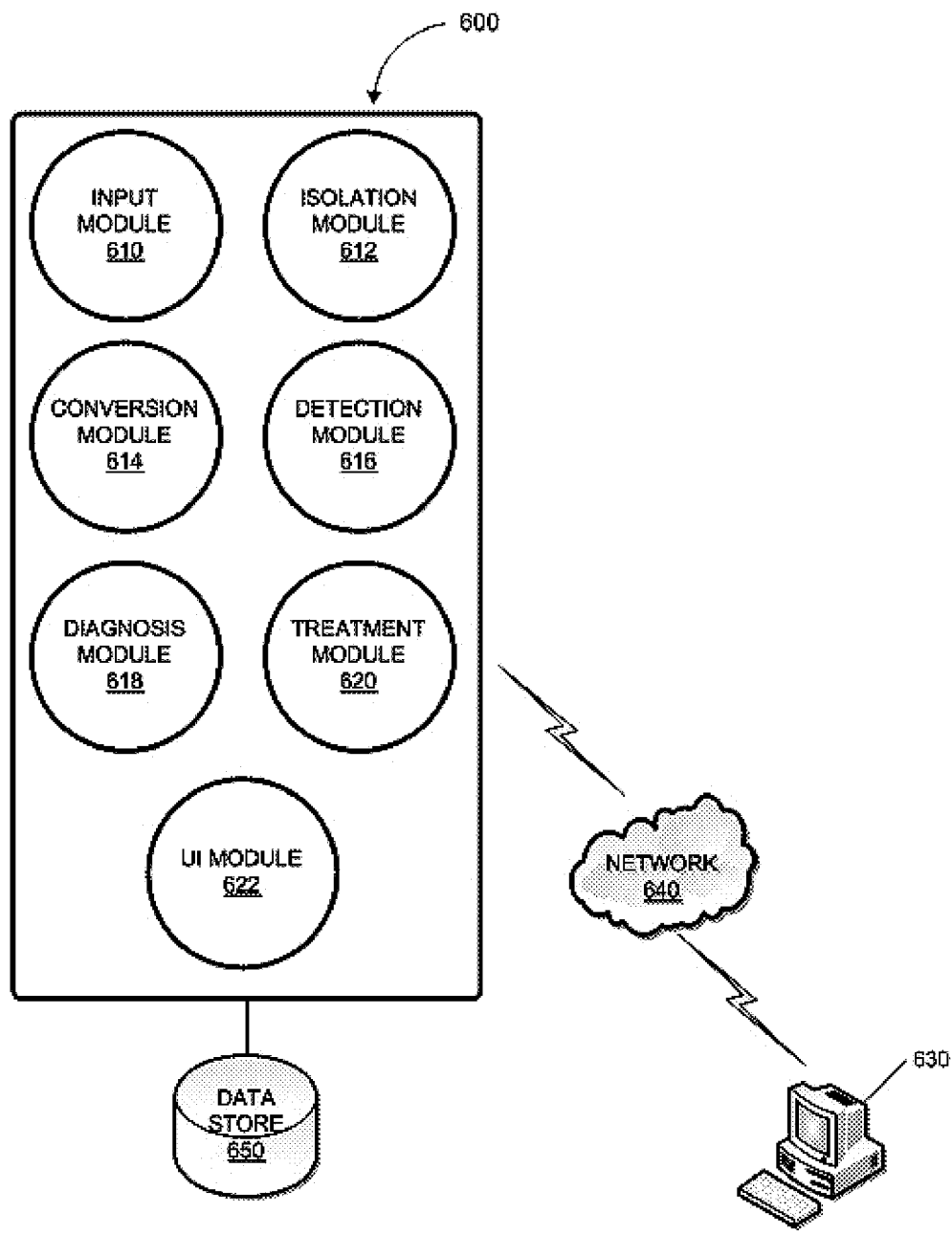
FIG. 2 depicts a block diagram illustrating an exemplary breast cancer diagnostics system.

FIG. 2 depicts a block diagram illustrating an exemplary breast cancer diagnostic system 600. Referring to FIG. 2, the breast cancer diagnostic system 600 can include an input module 610, an isolation module 612, a conversion module 614, a detection module 616, a diagnosis module 618, a treatment module 620, and a user interface (UI) module 622. The breast cancer diagnostic system 600 can be configured to provide a diagnosis indicative of a presence of IDC and/or a risk of developing IDC. Moreover, the breast cancer diagnostic system 600 can be further configured to generate a treatment plan for a subject based on the diagnosis. For instance, when the diagnosis indicates a presence and/or risk of IDC in a subject, the breast cancer diagnostic system 600 can recommend one or more treatments including, for example, surgery (e.g., lumpectomy or mastectomy), radiation therapy, chemotherapy, hormone therapy, targeted therapy, and/or administration of an active agent.

One or more modules of the breast cancer diagnostic system 600 can be realized in digital electronic circuitry, integrated circuitry, specially designed application specific integrated circuits (ASICs), field programmable gate arrays (FPGAs) computer hardware, firmware, software, and/or combinations thereof. The breast cancer diagnostic system 600 can further be communicatively coupled with one or more devices including, for example, a device 630. The breast cancer diagnostic system 600 can communicate with the device 620 via a wired and/or wireless network 640 (e.g., a wide area network (WAN), a local area network (LAN), and/or the Internet). As shown in FIG. 2, the breast cancer diagnostic system 600 can be further coupled with a data store 650.

The input module 610 can be adapted to receive and/or collect a sample of a DCIS cancer cell proliferation obtained from a subject. The isolation module 612 can be configured to isolate DNA from the DCIS cancer cell proliferation sample received by the input module 610 thereby forming isolated DCIS cancer cell proliferation DNA. The conversion module 614 can be configured to treat the isolated DCIS cancer cell proliferation DNA including by contacting the isolated DCIS cancer cell proliferation DNA with one or more bisulfite reagents including, for example, a bisulfite salt. Exposing the isolated DCIS cancer cell proliferation DNA to one or more bisulfite reagents can convert cytosine to uracil while 5-mC is left unmodified. Thus, the 5-mC present in the isolated DCIS cancer cell proliferation DNA will remain in the reacted DCIS cancer cell proliferation DNA. Meanwhile, any cytosine in the isolated DCIS cancer cell proliferation DNA will be replaced by uracil in the reacted DCIS cancer cell proliferation DNA. In embodiments, the treatment of the isolated DCIS cancer cell proliferation DNA can be performed by applying one or more kits (e.g., the Bisulflash DNA Modification Kit (Epigentek) or Imprint DNA Modification Kit (Sigma)).

In embodiments, the conversion module 614 can be further adapted to ensure optimal bisulfite conversion (e.g., with desired DNA fragment size for post-bisulfite ligation) by controlling one or more of a concentration of the bisulfite reagents, temperature, and reaction time period. It should be appreciated that the conversion module 614 can be adapted to use a different and/or additional type of reagent without departing from the scope of the present subject matter. For example, the conversion module 614 can treat the isolated DCIS cancer cell proliferation DNA with potassium chloride, which may reduce the thermophilic DNA degradation associated with the conversion of cytosine to uracil. Moreover, the conversion module 614 can be configured to perform additional processing of the reacted DCIS cancer cell proliferation DNA including, for example, desulphonation (e.g., with an alkalized solution), cleansing (e.g., by elution), and amplification (e.g., using the PCR method).

The detection module 616 can be configured to detect a methylation and/or unmethylation of the DCIS cancer cell proliferation DNA. For instance, the detection module 616 can detect methylation by detecting a presence of uracil in the reacted DCIS cancer cell proliferation DNA generated by the conversion module 614. Alternately and/or additionally, the detection module 616 can detect unmethylation by detecting an absence of uracil in the reacted DCIS cancer cell proliferation DNA. In embodiments, the detection module 616 can be configured detect the presence and/or absence of uracil at specific methylation sites. That is, the detection module 616 can be configured to detect the presence and/or absence of uracil at specific chromosomal positions of certain chromosomes. For example, the breast cancer diagnostic system 600 can store a plurality of specific methylation sites (e.g., Table 1) in the data store 650. As such, to detect methylation, the detection module 616 can be configured to obtain, from the data store 650, one or more specific methylation sites at which to test for the presence and/or absence of uracil. Moreover, in embodiments, the detection module 616 can be configured to determine a level of methylation and/or unmethylation at the specific methylation sites. The level of methylation at a particular site can correspond to a proportion of the reacted DCIS cancer cell proliferation DNA that has a cytosine rather than a uracil at that site. By contrast, the level of unmethylation at a particular site can correspond to a proportion of reacted DCIS cancer cell proliferation DNA that has a uracil rather than a cytosine at that site.

In embodiments, the conversion module 614 may amplify the reacted DCIS cancer cell proliferation DNA such as by using a PCR method. The detection of methylation and/or unmethylation in amplified reacted DCIS cancer cell proliferation DNA may require detection of a presence and/or absence of thymidine at a site of interest in amplicons amplified from the reacted DCIS cancer cell proliferation DNA. That is, instead of detecting the presence and/or absence of uracil, the detection module 616 can be configured to detect methylation and/or unmethylation of amplified reacted DCIS cancer cell proliferation DNA by detecting a presence and/or absence of thymidine at specific methylation sites (e.g., as set forth in Table 1).

The diagnosis module 618 can be configured to generate a diagnosis for the subject based on whether the detection module 616 detects methylation and/or unmethylation at the plurality of specific methylation sites (e.g., Table 1). Alternately or additionally, the diagnosis module 618 can be configured to generate a diagnosis for the subject based on a level of methylation and/or unmethylation detected by the detection module 616 at the plurality of specific methylation sites. For instance, diagnosis module 618 can determine that the DCIS cancer cell proliferation is invasive competent when the unmethylation level (e.g., proportion of uracil) at different methylation sites exceeds the corresponding thresholds (e.g., as set forth in Table 2).

The treatment module 620 can be configured to formulate a treatment plan for the subject based on the diagnosis generated by the diagnosis module 618. For instance, when the diagnosis generated by the diagnosis module 618 indicates a presence and/or risk of IDC, the treatment module 620 can prescribe or suggest one or more treatments including, for example, surgery, radiation therapy, chemotherapy, hormone therapy, and/or administration of an active agent. In embodiments, the treatment module 620 can be configured to provide the treatment plan to the device 630 via the network 640. Alternately or additionally, the treatment module 620 can store the treatment plan in the data store 650.

The UI module 622 can be configured to generate a UI through which a user (e.g., a physician) can interface with the breast cancer diagnostic system 600. For example, the UI module 622 can provide one or more graphic user interfaces (GUIs) configured to display the diagnosis and/or treatment plan for the subject.

Figure 3:
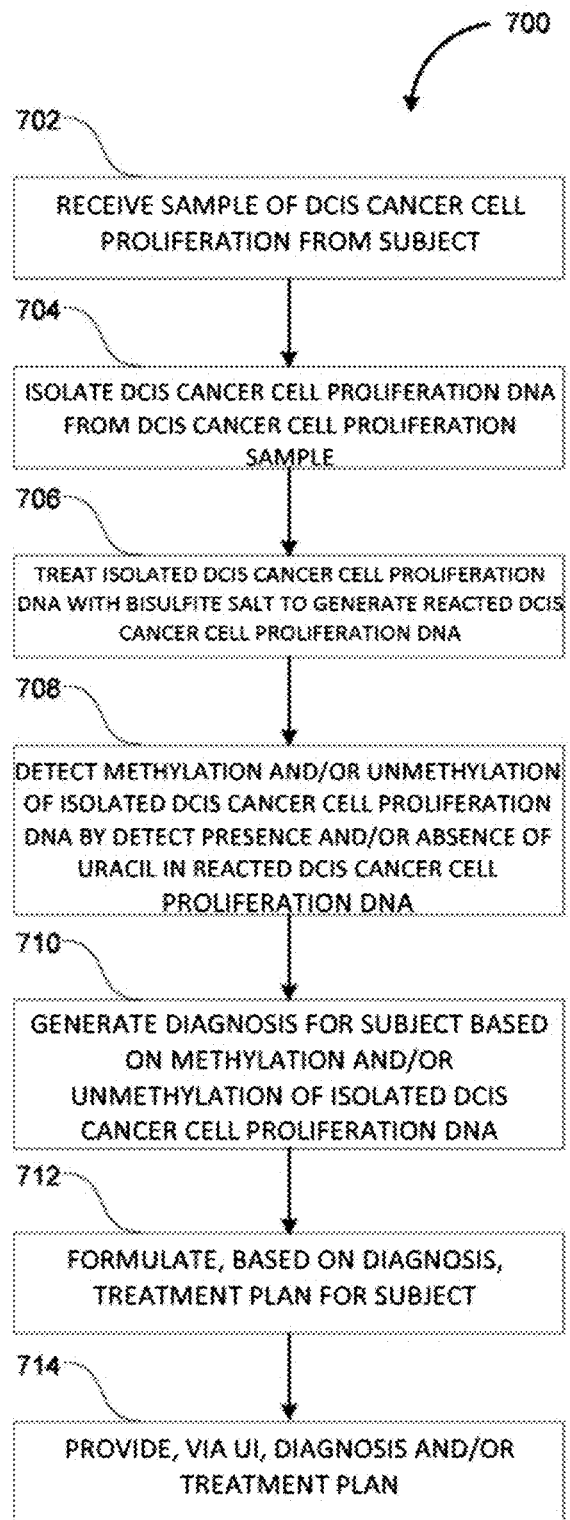
FIG. 3 depicts a flowchart illustrating an exemplary process for diagnosing breast cancer.
Figure 4:
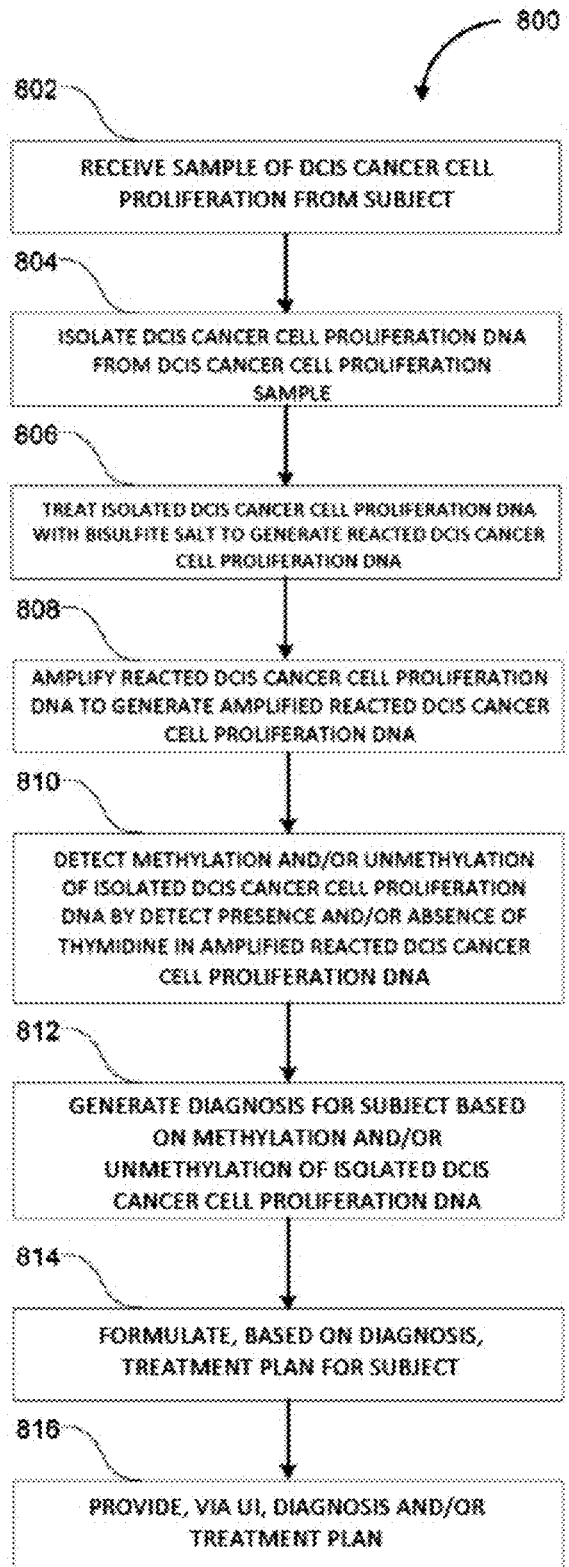
FIG. 4 depicts a flowchart illustrating an exemplary process for diagnosing breast cancer.

FIG. 5 depicts a flowchart illustrating an exemplary process 700 for diagnosing invasive or invasive competent breast cancer. Referring to FIGS. 3 and 4, the process 700 can be performed by the breast cancer diagnostic system 600.

The breast cancer diagnostic system 600 (e.g., the input module 610) can receive a sample of a DCIS cancer cell proliferation from a subject (702). The breast cancer diagnostic system 600 (e.g., the isolation module 612) can isolate DCIS cancer cell proliferation DNA from the DCIS cancer cell proliferation sample (704). The breast cancer diagnostic system 600 (e.g., the conversion module 614) can treat the isolated DCIS cancer cell proliferation DNA with a bisulfite salt to generate reacted DCIS cancer cell proliferation DNA (706). Treating the isolated DCIS cancer cell proliferation DNA with the bisulfite salt can form a reacted DCIS cancer cell proliferation DNA by converting the cytosine present in the isolated DCIS cancer cell proliferation DNA to uracil. In embodiments, the breast cancer diagnostic system 600 can further process the reacted DCIS cancer cell proliferation DNA by desulphonating, cleansing, and/or amplifying the reacted DCIS cancer cell proliferation DNA.

The breast cancer diagnostic system 600 (e.g., the detection module 616) can detect methylation and/or unmethylation of the isolated DCIS cancer cell proliferation DNA by at least detecting a presence and/or absence of uracil in the reacted DCIS cancer cell proliferation DNA (708). In embodiments, the breast cancer diagnostic system 600 can be configured to detect a presence and/or absence of uracil at specific methylation sites (e.g., as set forth in Table 1). Moreover, the breast cancer diagnostic system 600 can be configured to detect a level of methylation and/or unmethylation at the methylation sites.

The breast cancer diagnostic system 600 (e.g., the diagnostics module 618) can generate a diagnosis for the subject based on the methylation and/or unmethylation of the isolated DCIS cancer cell proliferation DNA (710). For example, the breast cancer diagnostic system 600 can generate a diagnosis based on a level of methylation and/or unmethylation at a plurality of specific methylation sites. Each methylation site may be associated with a certain threshold unmethylation level (e.g., as set forth in Table 2). As such, the breast cancer diagnostic system 600 can determine that the DCIS cancer cell proliferation from the subject is invasive if the level of unmethylation at the plurality of methylation sites exceeds (e.g., as set forth in Table 2) or is below (e.g., as set forth in Table 3) the corresponding thresholds.

The breast cancer diagnostic system 600 (e.g., the treatment module 620) can formulate, based on the diagnosis, a treatment plan for the subject (712). For example, when the diagnosis indicates that a presence and/or risk of IDC in the subject, the breast cancer diagnostic system 600 can prescribe or suggest surgery, radiation therapy, chemotherapy, hormone therapy, and/or administration of an active agent. The breast cancer diagnostic system 600 (e.g., the UI module 622) can provide, via a UI (e.g., GUI at the device 630), the diagnosis and/or the treatment plan for the subject (714).

FIG. 6 depicts a flowchart illustrating an exemplary process 800 for diagnosing IDC. Referring to FIGS. 2 and 4, the process 700 can be performed by the breast cancer diagnostic system 600.

The breast cancer diagnostic system 600 (e.g., the input module 610) can receive a sample of a DCIS cancer cell proliferation from a subject (802). The breast cancer diagnostic system 600 (e.g., the isolation module 612) can isolate DCIS cancer cell proliferation DNA from the DCIS cancer cell proliferation sample (804). The breast cancer diagnostic system 600 (e.g., the conversion module 614) can treat the isolated DCIS cancer cell proliferation DNA with a bisulfite salt to generate reacted DCIS cancer cell proliferation DNA (806).

As shown in FIG. 4, the breast cancer diagnostic system 600 (e.g., the conversion module 614) can amplify the reacted DCIS cancer cell proliferation DNA (808). For instance, the breast cancer diagnostic system 600 can amplify the reacted DCIS cancer cell proliferation DNA subsequent to treating the isolated DCIS cancer cell proliferation DNA with the bisulfite salt to generate amplicons of the reacted DCIS cancer cell proliferation DNA. The breast cancer diagnostic system 600 can detect methylation and/or unmethylation of the isolated DCIS cancer cell proliferation DNA by detecting a presence and/or absence of thymidine in the amplified reacted DCIS cancer cell proliferation DNA (810).

The breast cancer diagnostic system 600 (e.g., the diagnostics module 618) can generate a diagnosis for the subject based on the methylation and/or unmethylation of the isolated DCIS cancer cell proliferation DNA (812). Moreover, the breast cancer diagnostic system 600 (e.g., the treatment module 620) can formulate, based on the diagnosis, a treatment plan for the subject (814). The breast cancer diagnostic system 600 (e.g., the UI module 622) can provide, via a UI, the diagnosis and/or treatment plan for the subject.

It should be appreciated that the process 700 and/or 800 can include different and/or additional operations without departing from the scope of the present subject matter. Moreover, one or more operations of the process 700 and/or 800 can be omitted and/or repeated without departing from the scope of the present subject matter.

Implementations of the present subject matter can include, but are not limited to, methods consistent with the descriptions provided above as well as articles that comprise a tangibly embodied machine-readable medium operable to cause one or more machines (e.g., computers, etc.) to result in operations implementing one or more of the described features. Similarly, computer systems are also described that can include one or more processors and one or more memories coupled to the one or more processors. A memory, which can include a computer-readable storage medium, can include, encode, store, or the like one or more programs that cause one or more processors to perform one or more of the operations described herein. Computer implemented methods consistent with one or more implementations of the current subject matter can be implemented by one or more data processors residing in a single computing system or multiple computing systems. Such multiple computing systems can be connected and can exchange data and/or commands or other instructions or the like via one or more connections, including but not limited to a connection over a network (e.g. the Internet, a wireless wide area network, a local area network, a wide area network, a wired network, or the like), via a direct connection between one or more of the multiple computing systems, etc.

One or more aspects or features of the subject matter described herein can be realized in digital electronic circuitry, integrated circuitry, specially designed ASICs, FPGAs, computer hardware, firmware, software, and/or combinations thereof. These various aspects or features can include implementation in one or more computer programs that are executable and/or interpretable on a programmable system including at least one programmable processor, which can be special or general purpose, coupled to receive data and instructions from, and to transmit data and instructions to, a storage system, at least one input device, and at least one output device. The programmable system or computing system can include clients and servers. A client and server are generally remote from each other and typically interact through a communication network. The relationship of client and server arises by virtue of computer programs running on the respective computers and having a client-server relationship to each other.

These computer programs, which can also be referred to programs, software, software applications, applications, components, or code, include machine instructions for a programmable processor, and can be implemented in a high-level procedural language, an object-oriented programming language, a functional programming language, a logical programming language, and/or in assembly/machine language. As used herein, the term "machine-readable medium" refers to any computer program product, apparatus and/or device, such as for example magnetic discs, optical disks, memory, and Programmable Logic Devices (PLDs), used to provide machine instructions and/or data to a programmable processor, including a machine-readable medium that receives machine instructions as a machine-readable signal. The term "machine-readable signal" refers to any signal used to provide machine instructions and/or data to a programmable processor. The machine-readable medium can store such machine instructions non-transitorily, such as for example as would a non-transient solid-state memory or a magnetic hard drive or any equivalent storage medium. The machine-readable medium can alternatively or additionally store such machine instructions in a transient manner, such as for example as would a processor cache or other random access memory associated with one or more physical processor cores.

To provide for interaction with a user, one or more aspects or features of the subject matter described herein can be implemented on a computer having a display device, such as for example a cathode ray tube (CRT) or a liquid crystal display (LCD) or a light emitting diode (LED) monitor for displaying information to the user and a keyboard and a pointing device, such as for example a mouse or a trackball, by which the user may provide input to the computer. Other kinds of devices can be used to provide for interaction with a user as well. For example, feedback provided to the user can be any form of sensory feedback, such as for example visual feedback, auditory feedback, or tactile feedback; and input from the user can be received in any form, including, but not limited to, acoustic, speech, or tactile input. Other possible input devices include, but are not limited to, touch screens or other touch-sensitive devices such as single or multi-point resistive or capacitive trackpads, voice recognition hardware and software, optical scanners, optical pointers, digital MRI image capture devices and associated interpretation software, and the like.

EXAMPLES

Examples are provided below to facilitate a more complete understanding of the invention. The following examples illustrate the exemplary modes of making and practicing the invention. However, the scope of the invention is not limited to specific embodiments disclosed in these Examples, which are for purposes of illustration only, since alternative methods can be utilized to obtain similar results.

Example 1. Development of an Epigenetic Biomarker Panel for DCIS Invasiveness

DNA methylation patterns were evaluated in 7 DCIS samples from patients without reported invasion (pure DCIS), and 3 DCIS samples from patients with IDC. In order to identify DNA methylation changes exclusive to cancer cells, malignant cells located within the involved ducts of DICS were isolated by laser capture microdissection (FIG. 1A). Genome-wide profiling of DNA methylation was performed. Reduced representation bisulfate sequencing (RRBS) was used to evaluate DNA methylation patterns at gene promoters in captured cells (FIG. 1C). Clustering analysis clearly separated DCIS samples into two epigenetic groups. The first DCIS epigenetic group was associated with almost no DNA methylation at promoters and obtained from patients lacking invasion (pure DCIS). At the same time, specimens from the second epigenetic group of DCIS were characterized by extensive accumulation of DNA methylation at promoters. This group contained all analyzed DCIS from patients with IDC and 3 pure DCIS, according to a clinical pathology report.

In general, DNA methylation patterns strikingly separate normal from cancer cells and reflect genome-wide alterations of chromatin. While normal cells are missing DNA methylation at promoters, cancer is characterized by aberrant accumulation of promoter DNA methylation, which is frequently associated with gene silencing. Therefore, the first DCIS epigenetic group has a DNA methylation pattern very similar to normal cells. At the same time, the second DCIS epigenetic group exhibited a clear accumulation of cancer-associated DNA methylation and was highly enriched in DCIS associated with invasion.

Not to be bound by scientific theory, it was hypothesized that there are two different epigenetic programs driving DCIS progression, and patients with the "invasion incompetent" signature are unlikely to develop invasion while patients with pure DCIS from the second epigenetic group having "invasion competent" signature will have a very high chance to develop invasion. This hypothesis on the predictive power of epigenetic profiling is supported by the fact that on independent blinded pathology review of the "pure DCIS" cases, DCIS sample number 6 (DCIS_6) was reclassified as invasive (by a pathologist) that confirms the "invasion competent" signature identified by DNA methylation analysis. Thus, based on the DNA methylation pattern, the potential for invasiveness of DCIS can be predicted.

Figure 1D:
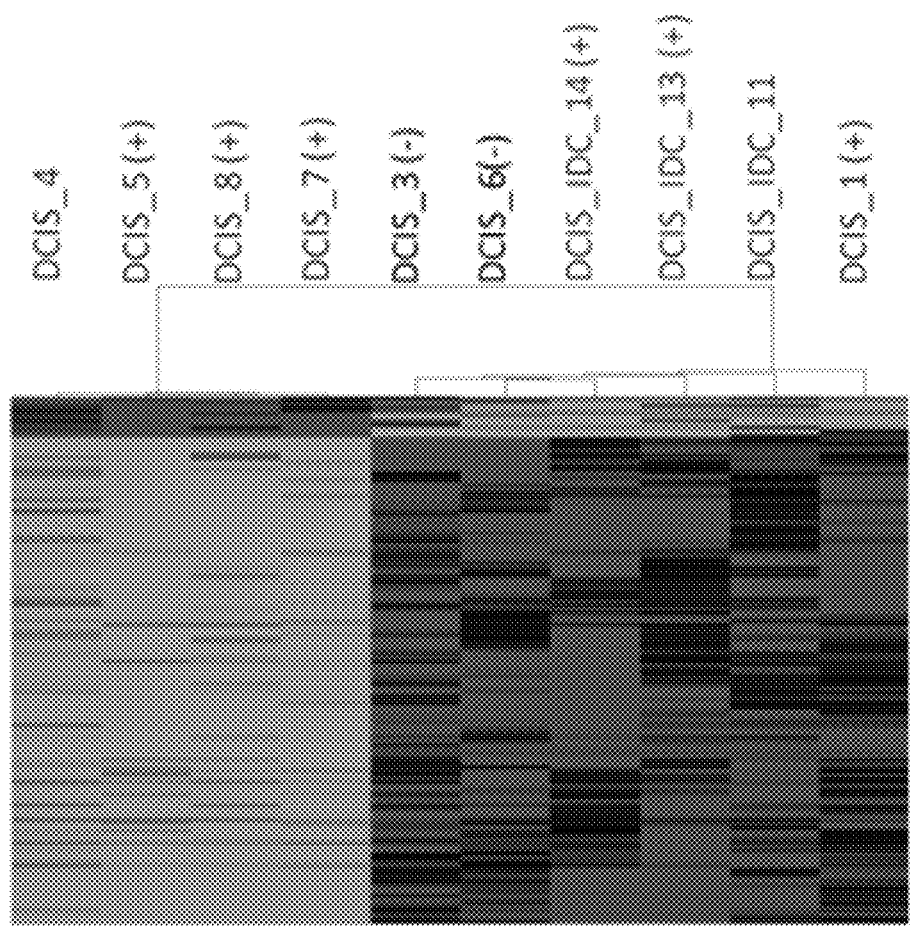

140 cytosines with DNA methylation patterns that strictly distinguish these two DCIS groups ("invasion incompetent" and "invasion competent") were identified (FIG. 1D). These epigenetic signatures can be used in diagnostic and prognostic DCIS tests for invasiveness that guide clinical management and potentially de-escalate therapy for DCIS with no potential for invasion.

DNA Methylation Profiling

By using LDM 7000 (Leica Microsystems), cancer cells were isolated from breast tissues by using laser capture procedure. Genomic DNA was purified by using a standard phenol/chloroform extraction approach followed by ethanol precipitation. Further genomic DNA underwent RRBS procedure. RRBS DNA amplicons were paired-end sequenced by using HighSeq (Illumina). For each sample, at least 15 million aligned reads were obtained. Specific methylation signatures for "invasion incompetent" and "invasion competent" cells were determined based on cytosines which are characterized by at least 5 sequencing reads in each sample.

OTHER EMBODIMENTS

While the invention has been described in conjunction with the detailed description thereof, the foregoing description is intended to illustrate and not limit the scope of the invention, which is defined by the scope of the appended claims. Other aspects, advantages, and modifications are within the scope of the following claims.

The patent and scientific literature referred to herein establishes the knowledge that is available to those with skill in the art. All United States patents and published or unpublished United States patent applications cited herein are incorporated by reference. All published foreign patents and patent applications cited herein are hereby incorporated by reference. Genbank and NCBI submissions indicated by accession number cited herein are hereby incorporated by reference. All other published references, documents, manuscripts and scientific literature cited herein are hereby incorporated by reference.

While this invention has been particularly shown and described with references to preferred embodiments thereof, it will be understood by those skilled in the art that various changes in form and details may be made therein without departing from the scope of the invention encompassed by the appended claims.

SEQUENCE LISTING (356 sequences)

SEQ ID NO: 1 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (7)..(7): c or u
  modified_base (20)..(20): c or u
  modified_base (37)..(37): c or u
  modified_base (39)..(39): c or u
  modified_base (48)..(48): c or u
  modified_base (57)..(57): c or u
  modified_base (78)..(78): c or u
  modified_base (84)..(84): c or u
  modified_base (108)..(108): c or u
  modified_base (121)..(121): c or u
  modified_base (127)..(127): c or u
  modified_base (133)..(133): c or u
  modified_base (138)..(138): c or u
  modified_base (146)..(146): c or u
  modified_base (150)..(150): c or u
  modified_base (156)..(156): c or u
  modified_base (158)..(158): c or u
  modified_base (167)..(167): c or u
  modified_base (189)..(189): c or u
  modified_base (192)..(192): c or u
  modified_base (195)..(195): c or u
  modified_base (199)..(199): c or u
  modified_base (202)..(202): c or u
  modified_base (220)..(220): c or u
  modified_base (230)..(230): c or u
  modified_base (239)..(239): c or u
  modified_base (253)..(253): c or u
  modified_base (258)..(258): c or u
  modified_base (260)..(260): c or u
  modified_base (264)..(264): c or u
  modified_base (295)..(295): c or u
gguungngtggutuagutunguuuuaggaaauttttngnguaguuuungutuuatgnguuuuuauuuagtuuttuttnggggunguuuuutuuuuaaagtagututungggtuuautgggnguuuungtaaungggtnggaauutngaangguttngngtguuatunggttauuutgguaauauuatunggnggnguunggnggtuuaatuutaguutgngguutututngaguutttnguaaggtggggaungggangngaunggggatggggaagggggutguaggagguuunguutg

SEQ ID NO: 2 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (36)..(36): c or u
  modified_base (40)..(40): c or u
  modified_base (42)..(42): c or u
  modified_base (47)..(47): c or u
  modified_base (61)..(61): c or u
  modified_base (70)..(70): c or u
  modified_base (80)..(80): c or u
  modified_base (98)..(98): c or u
  modified_base (101)..(101): c or u
  modified_base (105)..(105): c or u
  modified_base (108)..(108): c or u
  modified_base (111)..(111): c or u
  modified_base (133)..(133): c or u
  modified_base (142)..(142): c or u
  modified_base (144)..(144): c or u
  modified_base (150)..(150): c or u
  modified_base (154)..(154): c or u
  modified_base (162)..(162): c or u
  modified_base (167)..(167): c or u
  modified_base (173)..(173): c or u
  modified_base (179)..(179): c or u
  modified_base (192)..(192): c or u
  modified_base (216)..(216): c or u
  modified_base (222)..(222): c or u
  modified_base (243)..(243): c or u
  modified_base (252)..(252): c or u
  modified_base (261)..(261): c or u
  modified_base (263)..(263): c or u
  modified_base (280)..(280): c or u
  modified_base (293)..(293): c or u
  modified_base (295)..(295): c or u
uaggngggguutuutguaguuuuuttuuuuatuuunggtngngtuunggtuuuuauuttgngaaaggutngagagaggunguaggutaggattggaungungggngungunggatggtgttguuagggtaaunggatgguangngaagungttngaggttungauunggttangggggnguuuagtggauunggagagutautttggggagggggngguuungaagaaggautgggtgggggnguatggagngggggutgngngaaaagtttuutggggnggagutgaguuangnggguu

SEQ ID NO: 3 - DNA, 300 bp, Artificial Sequence
  Description of Artificial Sequence: Synthetic oligonucleotide
  Description of Combined DNA/RNA Molecule: Synthetic oligonucleotide
  modified_base (47)..(47): c or u
  modified_base (58)..(58): c or u
  modified_base (66)..(66): c or u
  modified_base (96)..(96): c or u
  modified_base (150)..(150): c or u
  modified_base (164)..(164): c or u
  modified_base (242)..(242): c or u
ttttutttttuttttuttttttuuttaagguagagtutggttutgtnguuuagagagnggtaauangatutuagutuautguaauututguutuungggttuaaguaattttuatguutuaggutuutgagtagutggagttauagguangtgutauuatguunggutaatgttttgtatttttagtagagauagggtttuauuatgttggutgggutggtuttgaautuuutauutuaagngatutgutuauutuagautuuuaaaatgutgggattauaggtgtgaguuauuauautg

SEQ ID NO: 4 - DNA, 300 bp, Artificial Sequence
  Description of Artificial Sequence: Synthetic oligonucleotide
  Description of Combined DNA/RNA Molecule: Synthetic oligonucleotide
  modified_base (58)..(58): c or u
  modified_base (136)..(136): c or u
  modified_base (150)..(150): c or u
  modified_base (204)..(204): c or u
  modified_base (234)..(234): c or u
  modified_base (242)..(242): c or u
  modified_base (253)..(253): c or u
uagtgtggtggutuauauutgtaatuuuaguattttgggagtutgaggtgaguagatnguttgaggtagggagttuaagauuaguuuaguuaauatggtgaaauuutgtututautaaaaatauaaaauattagunggguatggtaguangtguutgtaautuuagutautuaggaguutgagguatgaaaattguttgaauungggagguagaggttguagtgagutgagatngtgttaungutututgggngauagaauuagaututguuttaaggaaaaaagaaaagaaaaagaaaa

SEQ ID NO: 5 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (7)..(7): c or u
  modified_base (12)..(12): c or u
  modified_base (21)..(21): c or u
  modified_base (23)..(23): c or u
  modified_base (25)..(25): c or u
  modified_base (30)..(30): c or u
  modified_base (35)..(35): c or u
  modified_base (56)..(56): c or u
  modified_base (63)..(63): c or u
  modified_base (65)..(65): c or u
  modified_base (72)..(72): c or u
  modified_base (78)..(78): c or u
  modified_base (84)..(84): c or u
  modified_base (91)..(91): c or u
  modified_base (98)..(98): c or u
  modified_base (102)..(102): c or u
  modified_base (115)..(115): c or u
  modified_base (118)..(118): c or u
  modified_base (126)..(126): c or u
  modified_base (128)..(128): c or u
  modified_base (130)..(130): c or u
  modified_base (132)..(132): c or u
  modified_base (136)..(136): c or u
  modified_base (139)..(139): c or u
  modified_base (144)..(144): c or u
  modified_base (151)..(151): c or u
  modified_base (153)..(153): c or u
  modified_base (164)..(164): c or u
  modified_base (171)..(171): c or u
  modified_base (180)..(180): c or u
  modified_base (184)..(184): c or u
  modified_base (190)..(190): c or u
  modified_base (196)..(196): c or u
  modified_base (198)..(198): c or u
  modified_base (200)..(200): c or u
  modified_base (207)..(207): c or u
  modified_base (210)..(210): c or u
  modified_base (217)..(217): c or u
  modified_base (225)..(225): c or u
  modified_base (227)..(227): c or u
  modified_base (231)..(231): c or u
  modified_base (233)..(233): c or u
  modified_base (236)..(236): c or u
  modified_base (261)..(261): c or u
  modified_base (273)..(273): c or u
  modified_base (276)..(276): c or u
  modified_base (279)..(279): c or u
  modified_base (282)..(282): c or u
  modified_base (288)..(288): c or u
  modified_base (291)..(291): c or u
  modified_base (293)..(293): c or u
  modified_base (297)..(297): c or u
  modified_base (299)..(299): c or u
nguuuungguunguuatggungngnguuunggaungututgguttutggguutgangttgtgngngutgggngggggngguuungguutgngauuuunguunggutgtuuuuagngangtutgggngngngngagngungggangtguagngngagatuutggnggtgutngggutauungggngguuungguuungngnguuauungunguutuunggutguungngtungngungututtuatgutggauutgtauuanguuatggutggngangangangagganggngnguungng

SEQ ID NO: 6 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (3)..(3): c or u
  modified_base (7)..(7): c or u
  modified_base (9)..(9): c or u
  modified_base (12)..(12): c or u
  modified_base (18)..(18): c or u
  modified_base (21)..(21): c or u
  modified_base (24)..(24): c or u
  modified_base (27)..(27): c or u
  modified_base (39)..(39): c or u
  modified_base (64)..(64): c or u
  modified_base (67)..(67): c or u
  modified_base (69)..(69): c or u
  modified_base (73)..(73): c or u
  modified_base (75)..(75): c or u
  modified_base (83)..(83): c or u
  modified_base (90)..(90): c or u
  modified_base (93)..(93): c or u
  modified_base (100)..(100): c or u
  modified_base (102)..(102): c or u
  modified_base (104)..(104): c or u
  modified_base (110)..(110): c or u
  modified_base (116)..(116): c or u
  modified_base (120)..(120): c or u
  modified_base (129)..(129): c or u
  modified_base (136)..(136): c or u
  modified_base (147)..(147): c or u
  modified_base (149)..(149): c or u
  modified_base (156)..(156): c or u
  modified_base (161)..(161): c or u
  modified_base (164)..(164): c or u
  modified_base (168)..(168): c or u
  modified_base (170)..(170): c or u
  modified_base (172)..(172): c or u
  modified_base (174)..(174): c or u
  modified_base (182)..(182): c or u
  modified_base (185)..(185): c or u
  modified_base (198)..(198): c or u
  modified_base (202)..(202): c or u
  modified_base (209)..(209): c or u
  modified_base (216)..(216): c or u
  modified_base (222)..(222): c or u
  modified_base (228)..(228): c or u
  modified_base (235)..(235): c or u
  modified_base (237)..(237): c or u
  modified_base (244)..(244): c or u
  modified_base (265)..(265): c or u
  modified_base (270)..(270): c or u
  modified_base (275)..(275): c or u
  modified_base (277)..(277): c or u
  modified_base (279)..(279): c or u
  modified_base (288)..(288): c or u
  modified_base (293)..(293): c or u
  modified_base (299)..(299): c or u
ngngggngngungtuutngtngtngtnguuaguuatggngtggtauaggtuuaguatgaagagnggngnggangnggguagungggaggnggngggtggngngnggggunggggunguungggtaguungaguaunguuaggatutngngutguangtuunggngutngngngnguuuagangtngutggggauagungggngggggtnguaggunggggunguuuunguuuagngnguauaangtuagguuuagaaguuagagnggtunggggngngngguuatggngggungggggng

SEQ ID NO: 7 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (8)..(8): c or u
  modified_base (10)..(10): c or u
  modified_base (33)..(33): c or u
  modified_base (38)..(38): c or u
  modified_base (42)..(42): c or u
  modified_base (45)..(45): c or u
  modified_base (53)..(53): c or u
  modified_base (57)..(57): c or u
  modified_base (62)..(62): c or u
  modified_base (64)..(64): c or u
  modified_base (68)..(68): c or u
  modified_base (76)..(76): c or u
  modified_base (103)..(103): c or u
  modified_base (105)..(105): c or u
  modified_base (114)..(114): c or u
  modified_base (118)..(118): c or u
  modified_base (121)..(121): c or u
  modified_base (133)..(133): c or u
  modified_base (150)..(150): c or u
  modified_base (173)..(173): c or u
  modified_base (180)..(180): c or u
  modified_base (187)..(187): c or u
  modified_base (195)..(195): c or u
  modified_base (201)..(201): c or u
  modified_base (226)..(226): c or u
  modified_base (228)..(228): c or u
  modified_base (239)..(239): c or u
  modified_base (265)..(265): c or u
  modified_base (282)..(282): c or u
  modified_base (286)..(286): c or u
  modified_base (295)..(295): c or u
gtuagngngnguuatggatuaagatgatgaatngutgngganggnguagatgngggngguungnggunggguuuungggtaggggtgggaggtggagggggungngggggguunggungunguuattaautunggaattaggtutaagunguuuauuauuuaguuautguuunggggagnguuagungttggggngggagnggguuuaggatggggautgagauungngtuuuuuauungaauutggauutaguutuututgaanguagaggguagtgggunguunggaaggggngggga

SEQ ID NO: 8 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (14)..(14): c or u
  modified_base (18)..(18): c or u
  modified_base (35)..(35): c or u
  modified_base (61)..(61): c or u
  modified_base (72)..(72): c or u
  modified_base (74)..(74): c or u
  modified_base (99)..(99): c or u
  modified_base (105)..(105): c or u
  modified_base (113)..(113): c or u
  modified_base (120)..(120): c or u
  modified_base (127)..(127): c or u
  modified_base (150)..(150): c or u
  modified_base (167)..(167): c or u
  modified_base (179)..(179): c or u
  modified_base (182)..(182): c or u
  modified_base (186)..(186): c or u
  modified_base (195)..(195): c or u
  modified_base (197)..(197): c or u
  modified_base (224)..(224): c or u
  modified_base (232)..(232): c or u
  modified_base (236)..(236): c or u
  modified_base (238)..(238): c or u
  modified_base (243)..(243): c or u
  modified_base (247)..(247): c or u
  modified_base (255)..(255): c or u
  modified_base (258)..(258): c or u
  modified_base (262)..(262): c or u
  modified_base (267)..(267): c or u
  modified_base (290)..(290): c or u
  modified_base (292)..(292): c or u
  modified_base (294)..(294): c or u
tuuunguuuuttungggngguuuautguuututgngttuagaggaggutaggtuuaggttngggtgggggangngggtutuagtuuuuatuutggguungutuunguuuuaanggutggngutuuungggguagtggutgggtggtgggngguttagauutaattunggagttaatggnggnggunggguuuuungngguuuuutuuauutuuuauuuutauunggggguunggungngggunguunguatutgngungtunguagngattuatuatuttgatuuatggngngngutgau

SEQ ID NO: 9 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (13)..(13): c or u
  modified_base (16)..(16): c or u
  modified_base (22)..(22): c or u
  modified_base (29)..(29): c or u
  modified_base (35)..(35): c or u
  modified_base (37)..(37): c or u
  modified_base (43)..(43): c or u
  modified_base (58)..(58): c or u
  modified_base (73)..(73): c or u
  modified_base (79)..(79): c or u
  modified_base (85)..(85): c or u
  modified_base (92)..(92): c or u
  modified_base (104)..(104): c or u
  modified_base (116)..(116): c or u
  modified_base (118)..(118): c or u
  modified_base (131)..(131): c or u
  modified_base (146)..(146): c or u
  modified_base (148)..(148): c or u
  modified_base (151)..(151): c or u
  modified_base (167)..(167): c or u
  modified_base (173)..(173): c or u
  modified_base (179)..(179): c or u
  modified_base (181)..(181): c or u
  modified_base (184)..(184): c or u
  modified_base (197)..(197): c or u
  modified_base (207)..(207): c or u
  modified_base (223)..(223): c or u
  modified_base (227)..(227): c or u
  modified_base (229)..(229): c or u
  modified_base (233)..(233): c or u
  modified_base (245)..(245): c or u
  modified_base (248)..(248): c or u
  modified_base (254)..(254): c or u
  modified_base (257)..(257): c or u
uauunggauutungangguutnggtgttnguaggngngggatngguuuuagutuutgnguutguutuaggutnggguunggguunggguuunguagguutguunguuttuutgggngnggagutgggutgnguuaaaguuttutangnggngtuuutgagtuutuunguagungguaungnggngggtutguuuaunguauttutgnguuaggguutuaaganggangngggnggtggtguaggnggngggggngungggguaggguagagguuttuuttututatagauuauatuatgg

SEQ ID NO: 10 - DNA, 300 bp, Artificial Sequence
  Description of Artificial Sequence: Synthetic oligonucleotide
  Description of Combined DNA/RNA Molecule: Synthetic oligonucleotide
  modified_base (43)..(43): c or u
  modified_base (46)..(46): c or u
  modified_base (52)..(52): c or u
  modified_base (55)..(55): c or u
  modified_base (67)..(67): c or u
  modified_base (71)..(71): c or u
  modified_base (73)..(73): c or u
  modified_base (77)..(77): c or u
  modified_base (93)..(93): c or u
  modified_base (103)..(103): c or u
  modified_base (116)..(116): c or u
  modified_base (119)..(119): c or u
  modified_base (121)..(121): c or u
  modified_base (127)..(127): c or u
  modified_base (133)..(133): c or u
  modified_base (149)..(149): c or u
  modified_base (152)..(152): c or u
  modified_base (154)..(154): c or u
  modified_base (169)..(169): c or u
  modified_base (182)..(182): c or u
  modified_base (184)..(184): c or u
  modified_base (196)..(196): c or u
  modified_base (208)..(208): c or u
  modified_base (215)..(215): c or u
  modified_base (221)..(221): c or u
  modified_base (227)..(227): c or u
  modified_base (242)..(242): c or u
  modified_base (257)..(257): c or u
  modified_base (263)..(263): c or u
  modified_base (265)..(265): c or u
  modified_base (271)..(271): c or u
  modified_base (278)..(278): c or u
  modified_base (284)..(284): c or u
  modified_base (287)..(287): c or u
  modified_base (295)..(295): c or u
uuatgatgtggtutatagagaaggaagguututguuutguuunggnguuuungunguutguauuaunguungngtungtuttgagguuutggnguagaagtgnggtggguagauungungnggtgunggutgngggaggautuagggangungngtagaaggutttggnguaguuuagutungnguuuaggaaggnggguagguutgngggguunggguunggguungaguutgagguaggnguaggagutggggungatuungnguutgngaauaungaggungtnggaggtungggtg

SEQ ID NO: 11 - DNA, 300 bp, Artificial Sequence
  Description of Artificial Sequence: Synthetic oligonucleotide
  Description of Combined DNA/RNA Molecule: Synthetic oligonucleotide
  modified_base (15)..(15): c or u
  modified_base (26)..(26): c or u
  modified_base (34)..(34): c or u
  modified_base (47)..(47): c or u
  modified_base (65)..(65): c or u
  modified_base (80)..(80): c or u
  modified_base (83)..(83): c or u
  modified_base (109)..(109): c or u
  modified_base (111)..(111): c or u
  modified_base (120)..(120): c or u
  modified_base (125)..(125): c or u
  modified_base (127)..(127): c or u
  modified_base (130)..(130): c or u
  modified_base (149)..(149): c or u
  modified_base (151)..(151): c or u
  modified_base (160)..(160): c or u
  modified_base (170)..(170): c or u
  modified_base (191)..(191): c or u
  modified_base (200)..(200): c or u
  modified_base (210)..(210): c or u
  modified_base (229)..(229): c or u
  modified_base (231)..(231): c or u
  modified_base (240)..(240): c or u
  modified_base (245)..(245): c or u
  modified_base (271)..(271): c or u
  modified_base (290)..(290): c or u
atuutuautttgttngutuutuagtngtuuaggnggattuutttttnguuaggtaaggutgguungggtguatgggguunggngtguuutgggtaaggutgguuuaggngngtggggtunggggngngungggtaaggutggguuaggngngtggggtunggggtguuungggtaaggutggtuuaggggngtggggtunggggtguuungggtaaggutggtutaggngngtggggtunguagnguuuuaagtaaggutggtuuaggagngtgaggtuuagggtguuunggataaggut

SEQ ID NO: 12 - DNA, 300 bp, Artificial Sequence
  Description of Artificial Sequence: Synthetic oligonucleotide
  Description of Combined DNA/RNA Molecule: Synthetic oligonucleotide
  modified_base (10)..(10): c or u
  modified_base (29)..(29): c or u
  modified_base (55)..(55): c or u
  modified_base (60)..(60): c or u
  modified_base (69)..(69): c or u
  modified_base (71)..(71): c or u
  modified_base (90)..(90): c or u
  modified_base (100)..(100): c or u
  modified_base (109)..(109): c or u
  modified_base (130)..(130): c or u
  modified_base (140)..(140): c or u
  modified_base (149)..(149): c or u
  modified_base (151)..(151): c or u
  modified_base (170)..(170): c or u
  modified_base (173)..(173): c or u
  modified_base (175)..(175): c or u
  modified_base (180)..(180): c or u
  modified_base (189)..(189): c or u
  modified_base (191)..(191): c or u
  modified_base (217)..(217): c or u
  modified_base (220)..(220): c or u
  modified_base (235)..(235): c or u
  modified_base (253)..(253): c or u
  modified_base (266)..(266): c or u
  modified_base (274)..(274): c or u
  modified_base (285)..(285): c or u
aguuttatungggguauuutggauutuangutuutggauuaguuttauttggggngutgnggauuuuangnguutagauuaguuttauungggguauuunggauuuuanguuuutggauuaguuttauungggguauuunggauuuuangnguutgguuuaguuttauunggngnguuunggauuuuangnguutggguuaguuttauuuaggguangunggguuuuatguauunggguuaguuttauutggngaaaaaggaatunguutggangautgaggagngaauaaagtgaggat

SEQ ID NO: 13 - DNA, 300 bp, Artificial Sequence
  Description of Artificial Sequence: Synthetic oligonucleotide
  Description of Combined DNA/RNA Molecule: Synthetic oligonucleotide
  modified_base (29)..(29): c or u
  modified_base (39)..(39): c or u
  modified_base (51)..(51): c or u
  modified_base (56)..(56): c or u
  modified_base (58)..(58): c or u
  modified_base (61)..(61): c or u
  modified_base (104)..(104): c or u
  modified_base (117)..(117): c or u
  modified_base (132)..(132): c or u
  modified_base (150)..(150): c or u
  modified_base (191)..(191): c or u
  modified_base (202)..(202): c or u
  modified_base (217)..(217): c or u
  modified_base (243)..(243): c or u
  modified_base (253)..(253): c or u
  modified_base (283)..(283): c or u
  modified_base (287)..(287): c or u
  modified_base (290)..(290): c or u
  modified_base (296)..(296): c or u
uaagagattaguauaatagatututaaungaggggaagngttguttttuangutangngungtaattaatggtatgaatuaattaatttgauttttattgtgtngaaggaaaaaagnguaauaaatggaaungguagutgggagttgttngtuutuuauuuuuttuuuuagggaggttuuaaggagauaunggggaatgganggatuaggutgggungtgguagagggagggtaggagguagngauuaguagngtggagggagtuuagagagutaguututgngganggnggaatngaaa

SEQ ID NO: 14 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (10)..(10): c or u
  modified_base (13)..(13): c or u
  modified_base (17)..(17): c or u
  modified_base (47)..(47): c or u
  modified_base (57)..(57): c or u
  modified_base (83)..(83): c or u
  modified_base (98)..(98): c or u
  modified_base (109)..(109): c or u
  modified_base (150)..(150): c or u
  modified_base (168)..(168): c or u
  modified_base (183)..(183): c or u
  modified_base (196)..(196): c or u
  modified_base (239)..(239): c or u
  modified_base (242)..(242): c or u
  modified_base (244)..(244): c or u
  modified_base (249)..(249): c or u
  modified_base (261)..(261): c or u
  modified_base (271)..(271): c or u
tttngattungungtunguagaggutagutututggautuuutuuangutgutggtngutguutuutauuutuuututguuangguuuaguutgatungtuuattuuunggtgtutuuttggaauutuuutggggaagggggtggaggangaauaautuuuagutgunggttuuatttgttgnguttttttuuttngauauaataaaagtuaaattaattgattuatauuattaattanggngngtagngtgaaaaguaanguttuuuutnggttagagatutattgtgutaatututtg

SEQ ID NO: 15 - DNA, 300 bp, Artificial Sequence
  Description of Artificial Sequence: Synthetic oligonucleotide
  Description of Combined DNA/RNA Molecule: Synthetic oligonucleotide
  modified_base (76)..(76): c or u
  modified_base (78)..(78): c or u
  modified_base (97)..(97): c or u
  modified_base (103)..(103): c or u
  modified_base (110)..(110): c or u
  modified_base (113)..(113): c or u
  modified_base (115)..(115): c or u
  modified_base (151)..(151): c or u
  modified_base (163)..(163): c or u
  modified_base (173)..(173): c or u
  modified_base (181)..(181): c or u
  modified_base (187)..(187): c or u
  modified_base (202)..(202): c or u
  modified_base (215)..(215): c or u
  modified_base (218)..(218): c or u
  modified_base (232)..(232): c or u
  modified_base (281)..(281): c or u
uatgggaaaguaaaattaaggguaauattgaggaagutuattaatatttagtttagaagatguaaagggttuttungngaauutggaagaguuuuungggutnguututngungnggtuuuauauttguutgauutuaauuauaututuunggtuuagguuungutggagaangtuuuaungautunggggauagaaaggungtttatgtaaaangangtttttuutatttnguutuuuauuutuatguaaattttgattttuaaututtuuaauuuttunguauuutgaaauaaauutu

SEQ ID NO: 16 - DNA, 300 bp, Artificial Sequence
  Description of Artificial Sequence: Synthetic oligonucleotide
  Description of Combined DNA/RNA Molecule: Synthetic oligonucleotide
  modified_base (19)..(19): c or u
  modified_base (68)..(68): c or u
  modified_base (82)..(82): c or u
  modified_base (85)..(85): c or u
  modified_base (98)..(98): c or u
  modified_base (113)..(113): c or u
  modified_base (119)..(119): c or u
  modified_base (127)..(127): c or u
  modified_base (137)..(137): c or u
  modified_base (149)..(149): c or u
  modified_base (185)..(185): c or u
  modified_base (187)..(187): c or u
  modified_base (190)..(190): c or u
  modified_base (197)..(197): c or u
  modified_base (203)..(203): c or u
  modified_base (222)..(222): c or u
  modified_base (224)..(224): c or u
gaggtttgtttuagggtgnggaagggttggaagagttgaaaatuaaaatttguatgagggtgggaggngaaataggaaaaangtngttttauataaangguutttutgtuuunggagtnggtgggangttutuuagngggguutggaungggagagtgtggttgaggtuagguaagtgtgggaungnggngagaggngaguunggggggututtuuaggttngnggaagaauuutttguatuttutaaautaaatattaatgaguttuutuaatgttguuuttaattttgutttuuuatg

SEQ ID NO: 17 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (19)..(19): c or u
  modified_base (25)..(25): c or u
  modified_base (29)..(29): c or u
  modified_base (34)..(34): c or u
  modified_base (36)..(36): c or u
  modified_base (39)..(39): c or u
  modified_base (45)..(45): c or u
  modified_base (48)..(48): c or u
  modified_base (50)..(50): c or u
  modified_base (63)..(63): c or u
  modified_base (69)..(69): c or u
  modified_base (75)..(75): c or u
  modified_base (81)..(81): c or u
  modified_base (87)..(87): c or u
  modified_base (93)..(93): c or u
  modified_base (99)..(99): c or u
  modified_base (105)..(105): c or u
  modified_base (111)..(111): c or u
  modified_base (114)..(114): c or u
  modified_base (124)..(124): c or u
  modified_base (133)..(133): c or u
  modified_base (136)..(136): c or u
  modified_base (139)..(139): c or u
  modified_base (142)..(142): c or u
  modified_base (145)..(145): c or u
  modified_base (151)..(151): c or u
  modified_base (175)..(175): c or u
  modified_base (179)..(179): c or u
  modified_base (185)..(185): c or u
  modified_base (191)..(191): c or u
  modified_base (194)..(194): c or u
  modified_base (197)..(197): c or u
  modified_base (201)..(201): c or u
  modified_base (203)..(203): c or u
  modified_base (215)..(215): c or u
  modified_base (219)..(219): c or u
  modified_base (221)..(221): c or u
  modified_base (228)..(228): c or u
  modified_base (232)..(232): c or u
  modified_base (236)..(236): c or u
  modified_base (238)..(238): c or u
  modified_base (240)..(240): c or u
  modified_base (246)..(246): c or u
  modified_base (257)..(257): c or u
  modified_base (259)..(259): c or u
  modified_base (266)..(266): c or u
  modified_base (278)..(278): c or u
  modified_base (280)..(280): c or u
  modified_base (282)..(282): c or u
  modified_base (289)..(289): c or u
  modified_base (298)..(298): c or u
gaauttgngutuuaggaangautgnguangtggngnggnggtggnggngnggaggauuuaggngaaggngaaggngaaggngaaggnguaggngaaggngaaggnguaggnggngggaagutanguuaaagungungungungungutgunggggtutguuuauaguutgguaungggngguagnggtggnggnggnggangngguaggtguagngaungngaaguungggnggungngnguuutnggaautuuuungnggutuungaggtgguagungngnguuautngguaguuungt

SEQ ID NO: 18 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (11)..(11): c or u
  modified_base (18)..(18): c or u
  modified_base (20)..(20): c or u
  modified_base (22)..(22): c or u
  modified_base (34)..(34): c or u
  modified_base (41)..(41): c or u
  modified_base (43)..(43): c or u
  modified_base (54)..(54): c or u
  modified_base (60)..(60): c or u
  modified_base (62)..(62): c or u
  modified_base (64)..(64): c or u
  modified_base (68)..(68): c or u
  modified_base (72)..(72): c or u
  modified_base (79)..(79): c or u
  modified_base (81)..(81): c or u
  modified_base (85)..(85): c or u
  modified_base (97)..(97): c or u
  modified_base (99)..(99): c or u
  modified_base (103)..(103): c or u
  modified_base (106)..(106): c or u
  modified_base (109)..(109): c or u
  modified_base (115)..(115): c or u
  modified_base (121)..(121): c or u
  modified_base (125)..(125): c or u
  modified_base (149)..(149): c or u
  modified_base (155)..(155): c or u
  modified_base (158)..(158): c or u
  modified_base (161)..(161): c or u
  modified_base (164)..(164): c or u
  modified_base (167)..(167): c or u
  modified_base (176)..(176): c or u
  modified_base (186)..(186): c or u
  modified_base (189)..(189): c or u
  modified_base (195)..(195): c or u
  modified_base (201)..(201): c or u
  modified_base (207)..(207): c or u
  modified_base (213)..(213): c or u
  modified_base (219)..(219): c or u
  modified_base (225)..(225): c or u
  modified_base (231)..(231): c or u
  modified_base (237)..(237): c or u
  modified_base (250)..(250): c or u
  modified_base (252)..(252): c or u
  modified_base (255)..(255): c or u
  modified_base (261)..(261): c or u
  modified_base (264)..(264): c or u
  modified_base (266)..(266): c or u
  modified_base (271)..(271): c or u
  modified_base (275)..(275): c or u
  modified_base (281)..(281): c or u
  modified_base (292)..(292): c or u
anggggutgungagtggngngnggutguuauutngggagungngggggagttungagggngngnggunguunggguttngnggtngutguauutgungngtungungunguuaungutgunguunggtguuaggutgtggguagauuungguagnggnggnggnggnggutttggngtaguttuungunguutgnguuttnguuttnguutgnguuttnguuttnguuttnguuttnguutgggtuutungngunguuaungungnguuangtgnguagtngttuutggagnguaagttu

SEQ ID NO: 19 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (15)..(15): c or u
  modified_base (33)..(33): c or u
  modified_base (43)..(43): c or u
  modified_base (56)..(56): c or u
  modified_base (60)..(60): c or u
  modified_base (75)..(75): c or u
  modified_base (82)..(82): c or u
  modified_base (97)..(97): c or u
  modified_base (123)..(123): c or u
  modified_base (141)..(141): c or u
  modified_base (151)..(151): c or u
  modified_base (153)..(153): c or u
  modified_base (176)..(176): c or u
  modified_base (197)..(197): c or u
  modified_base (225)..(225): c or u
  modified_base (244)..(244): c or u
guaunguttguuttngutagaggaagaagagangguuutgagnguaguatuauutnggunggttggagtutguunggutgunguuagggggtgatgnguuutuauutttuutuuaggatguungggatuuuaaggagggtngtgggtutungngtuuuaauutggaguuttgguungggatgatauuuttgguuaungguaguaggtututggtgguuauutganguttgaguatttuttutgnggauuutgggaagtuutauuuuttggautuataaaatatuttggttgtuuaaaggt

SEQ ID NO: 20 - DNA, 300 bp, Artificial Sequence
  Description of Artificial Sequence: Synthetic oligonucleotide
  Description of Combined DNA/RNA Molecule: Synthetic oligonucleotide
  modified_base (56)..(56): c or u
  modified_base (75)..(75): c or u
  modified_base (103)..(103): c or u
  modified_base (124)..(124): c or u
  modified_base (147)..(147): c or u
  modified_base (149)..(149): c or u
  modified_base (159)..(159): c or u
  modified_base (177)..(177): c or u
  modified_base (203)..(203): c or u
  modified_base (218)..(218): c or u
  modified_base (225)..(225): c or u
  modified_base (240)..(240): c or u
  modified_base (244)..(244): c or u
  modified_base (257)..(257): c or u
  modified_base (267)..(267): c or u
  modified_base (285)..(285): c or u
  modified_base (295)..(295): c or u
auutttggauaauuaagatattttatgagtuuaaggggtaggauttuuuagggtunguagaagaaatgutuaagngtuaggtgguuauuagagauutgutgunggtgguuaagggtatuatuunggguuaaggutuuaggttgggangnggagauuuangauuutuuttgggatuunggguatuutggaggaaaggtgagggnguatuauuuuutggngguagunggguagautuuaaunggungaggtgatgutgngutuagggungtututtuttuututagngaagguaagnggtgu

SEQ ID NO: 21 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (10)..(10): c or u
  modified_base (14)..(14): c or u
  modified_base (16)..(16): c or u
  modified_base (37)..(37): c or u
  modified_base (39)..(39): c or u
  modified_base (66)..(66): c or u
  modified_base (70)..(70): c or u
  modified_base (85)..(85): c or u
  modified_base (87)..(87): c or u
  modified_base (93)..(93): c or u
  modified_base (104)..(104): c or u
  modified_base (110)..(110): c or u
  modified_base (127)..(127): c or u
  modified_base (132)..(132): c or u
  modified_base (138)..(138): c or u
  modified_base (140)..(140): c or u
  modified_base (145)..(145): c or u
  modified_base (151)..(151): c or u
  modified_base (168)..(168): c or u
  modified_base (171)..(171): c or u
  modified_base (188)..(188): c or u
  modified_base (195)..(195): c or u
  modified_base (203)..(203): c or u
  modified_base (209)..(209): c or u
  modified_base (211)..(211): c or u
  modified_base (215)..(215): c or u
  modified_base (220)..(220): c or u
  modified_base (226)..(226): c or u
  modified_base (234)..(234): c or u
  modified_base (266)..(266): c or u
  modified_base (270)..(270): c or u
  modified_base (273)..(273): c or u
  modified_base (282)..(282): c or u
  modified_base (286)..(286): c or u
  modified_base (291)..(291): c or u
  modified_base (294)..(294): c or u
utgunguutnguungngggautuuutggaggagutungnguuutuututuuatuutuagagutgungggnggutggaguaguagngngggagngutagggguangggagnguagtuuutgtggagtngutgngggtungngtggngtguungggggauuutaaagaungtngggtgggggutgagggngaggggngggauaunggggungngggnggggnguauunggaauuungauagutgtgtuttggtggagutgtggautgnguungungautuuuanggunggggnggngutgaa

SEQ ID NO: 22 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (9)..(9): c or u
  modified_base (14)..(14): c or u
  modified_base (18)..(18): c or u
  modified_base (27)..(27): c or u
  modified_base (30)..(30): c or u
  modified_base (34)..(34): c or u
  modified_base (66)..(66): c or u
  modified_base (74)..(74): c or u
  modified_base (80)..(80): c or u
  modified_base (85)..(85): c or u
  modified_base (89)..(89): c or u
  modified_base (91)..(91): c or u
  modified_base (97)..(97): c or u
  modified_base (105)..(105): c or u
  modified_base (112)..(112): c or u
  modified_base (129)..(129): c or u
  modified_base (132)..(132): c or u
  modified_base (149)..(149): c or u
  modified_base (155)..(155): c or u
  modified_base (160)..(160): c or u
  modified_base (162)..(162): c or u
  modified_base (168)..(168): c or u
  modified_base (173)..(173): c or u
  modified_base (190)..(190): c or u
  modified_base (196)..(196): c or u
  modified_base (207)..(207): c or u
  modified_base (213)..(213): c or u
  modified_base (215)..(215): c or u
  modified_base (230)..(230): c or u
  modified_base (234)..(234): c or u
  modified_base (261)..(261): c or u
  modified_base (263)..(263): c or u
  modified_base (284)..(284): c or u
  modified_base (286)..(286): c or u
  modified_base (290)..(290): c or u
  modified_base (295)..(295): c or u
ttuagngunguuunggungtgggagtnggngggnguagtuuauagutuuauuaagauauagutgtnggggttungggtgnguuunguungngguuunggtgtuunguuuutnguuutuaguuuuuauunganggtutttagggtuuuunggguanguuangnggauunguagngautuuauagggautgngutuungtguuuutagngutuungngutgutgutuuagunguungguagututgaggatggagaggagggngnggagutuutuuagggagtuungngggngaggngguag

SEQ ID NO: 23 - DNA, 300 bp, Artificial Sequence
  Description of Artificial Sequence: Synthetic oligonucleotide
  Description of Combined DNA/RNA Molecule: Synthetic oligonucleotide
  modified_base (15)..(15): c or u
  modified_base (21)..(21): c or u
  modified_base (41)..(41): c or u
  modified_base (45)..(45): c or u
  modified_base (49)..(49): c or u
  modified_base (59)..(59): c or u
  modified_base (63)..(63): c or u
  modified_base (67)..(67): c or u
  modified_base (71)..(71): c or u
  modified_base (80)..(80): c or u
  modified_base (88)..(88): c or u
  modified_base (99)..(99): c or u
  modified_base (101)..(101): c or u
  modified_base (108)..(108): c or u
  modified_base (118)..(118): c or u
  modified_base (128)..(128): c or u
  modified_base (130)..(130): c or u
  modified_base (134)..(134): c or u
  modified_base (140)..(140): c or u
  modified_base (149)..(149): c or u
  modified_base (151)..(151): c or u
  modified_base (167)..(167): c or u
  modified_base (169)..(169): c or u
  modified_base (171)..(171): c or u
  modified_base (176)..(176): c or u
  modified_base (184)..(184): c or u
  modified_base (187)..(187): c or u
  modified_base (206)..(206): c or u
  modified_base (221)..(221): c or u
  modified_base (238)..(238): c or u
  modified_base (268)..(268): c or u
  modified_base (273)..(273): c or u
  modified_base (277)..(277): c or u
  modified_base (289)..(289): c or u
tgtggtgutguttgngutgunggtgguutggggtgagaggngggngggngtggggaggnguungggnggangaggaauungggguuunguagagaautngngtguagngutgagutgngutgututgngnguungggtungaagguagngngatgggtgggutgagngngngauungguagggnggngggtgtaggatuuttutgnguautggagauuutngutguttutgggtaagngtggagttuuuaggtguagggguttaagtngtgangagnguagtggaaggnguagatgutga

SEQ ID NO: 24 - DNA, 300 bp, Artificial Sequence
  Description of Artificial Sequence: Synthetic oligonucleotide
  Description of Combined DNA/RNA Molecule: Synthetic oligonucleotide
  modified_base (11)..(11): c or u
  modified_base (23)..(23): c or u
  modified_base (27)..(27): c or u
  modified_base (32)..(32): c or u
  modified_base (62)..(62): c or u
  modified_base (79)..(79): c or u
  modified_base (94)..(94): c or u
  modified_base (113)..(113): c or u
  modified_base (116)..(116): c or u
  modified_base (124)..(124): c or u
  modified_base (129)..(129): c or u
  modified_base (131)..(131): c or u
  modified_base (133)..(133): c or u
  modified_base (149)..(149): c or u
  modified_base (151)..(151): c or u
  modified_base (160)..(160): c or u
  modified_base (166)..(166): c or u
  modified_base (170)..(170): c or u
  modified_base (172)..(172): c or u
  modified_base (182)..(182): c or u
  modified_base (192)..(192): c or u
  modified_base (199)..(199): c or u
  modified_base (201)..(201): c or u
  modified_base (212)..(212): c or u
  modified_base (220)..(220): c or u
  modified_base (229)..(229): c or u
  modified_base (233)..(233): c or u
  modified_base (237)..(237): c or u
  modified_base (241)..(241): c or u
  modified_base (251)..(251): c or u
  modified_base (255)..(255): c or u
  modified_base (259)..(259): c or u
  modified_base (279)..(279): c or u
  modified_base (285)..(285): c or u
tuaguatutgnguuttuuautgngutngtuangauttaaguuuutguauutgggaautuuanguttauuuagaaguagngagggtutuuagtgnguagaaggatuutauauungunguuutgungggtngngngutuaguuuauuuatngngutguuttnggauungggngnguagaguagnguagutuagngutguangngagttututgngggguuungggttuutngtunguungggnguutuuuuanguunguunguututuauuuuagguuaungguagnguaaguaguauuaua

SEQ ID NO: 25 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (10)..(10): c or u
  modified_base (17)..(17): c or u
  modified_base (23)..(23): c or u
  modified_base (28)..(28): c or u
  modified_base (39)..(39): c or u
  modified_base (48)..(48): c or u
  modified_base (64)..(64): c or u
  modified_base (66)..(66): c or u
  modified_base (71)..(71): c or u
  modified_base (79)..(79): c or u
  modified_base (81)..(81): c or u
  modified_base (85)..(85): c or u
  modified_base (89)..(89): c or u
  modified_base (93)..(93): c or u
  modified_base (95)..(95): c or u
  modified_base (107)..(107): c or u
  modified_base (118)..(118): c or u
  modified_base (125)..(125): c or u
  modified_base (129)..(129): c or u
  modified_base (132)..(132): c or u
  modified_base (136)..(136): c or u
  modified_base (143)..(143): c or u
  modified_base (149)..(149): c or u
  modified_base (151)..(151): c or u
  modified_base (168)..(168): c or u
  modified_base (175)..(175): c or u
  modified_base (197)..(197): c or u
  modified_base (207)..(207): c or u
  modified_base (210)..(210): c or u
  modified_base (213)..(213): c or u
  modified_base (216)..(216): c or u
  modified_base (219)..(219): c or u
  modified_base (226)..(226): c or u
  modified_base (228)..(228): c or u
  modified_base (235)..(235): c or u
  modified_base (242)..(242): c or u
  modified_base (248)..(248): c or u
  modified_base (251)..(251): c or u
  modified_base (259)..(259): c or u
  modified_base (261)..(261): c or u
  modified_base (273)..(273): c or u
  modified_base (282)..(282): c or u
  modified_base (288)..(288): c or u
  modified_base (294)..(294): c or u
guttuuungngtuutunggguungggunguuutuutuunguauagtgnggaguagggagguuungnguutngauuauungnguungagngtungnguutuutuutungututguaggnggggaunguunggngutngguauungguagngngguuuuutuuaguuuunggutuungguaguagaaguagaagguagnguuaggggungungungungungagutungnggggutngggagungguuunggngaggaggngnggaauuatggungatgggggngagggngaagangagatu

SEQ ID NO: 26 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (12)..(12): c or u
  modified_base (18)..(18): c or u
  modified_base (27)..(27): c or u
  modified_base (39)..(39): c or u
  modified_base (41)..(41): c or u
  modified_base (49)..(49): c or u
  modified_base (52)..(52): c or u
  modified_base (58)..(58): c or u
  modified_base (65)..(65): c or u
  modified_base (72)..(72): c or u
  modified_base (74)..(74): c or u
  modified_base (81)..(81): c or u
  modified_base (84)..(84): c or u
  modified_base (87)..(87): c or u
  modified_base (90)..(90): c or u
  modified_base (93)..(93): c or u
  modified_base (103)..(103): c or u
  modified_base (125)..(125): c or u
  modified_base (132)..(132): c or u
  modified_base (149)..(149): c or u
  modified_base (151)..(151): c or u
  modified_base (157)..(157): c or u
  modified_base (164)..(164): c or u
  modified_base (168)..(168): c or u
  modified_base (171)..(171): c or u
  modified_base (175)..(175): c or u
  modified_base (182)..(182): c or u
  modified_base (193)..(193): c or u
  modified_base (205)..(205): c or u
  modified_base (207)..(207): c or u
  modified_base (211)..(211): c or u
  modified_base (215)..(215): c or u
  modified_base (219)..(219): c or u
  modified_base (221)..(221): c or u
  modified_base (229)..(229): c or u
  modified_base (234)..(234): c or u
  modified_base (236)..(236): c or u
  modified_base (252)..(252): c or u
  modified_base (261)..(261): c or u
  modified_base (272)..(272): c or u
  modified_base (277)..(277): c or u
  modified_base (283)..(283): c or u
  modified_base (290)..(290): c or u
  modified_base (292)..(292): c or u
gatutngtuttnguuutnguuuuuatngguuatggttungnguutuutngunggggunggutuungaguuungnggagutnggnggnggnggngguuuutggngutguuttutguttutgutgungggagungggggutggagggggungngutgungggtgungagngungggnggtuuunguutguagagnggaggaggaggngnggangutngggngngggtggtngaggngngggguutuuutgutunguautgtgngggaggagggngguunggguunggaggangnggggaagu

SEQ ID NO: 27 - DNA, 300 bp, Artificial Sequence
  Description of Artificial Sequence: Synthetic oligonucleotide
  Description of Combined DNA/RNA Molecule: Synthetic oligonucleotide
  modified_base (16)..(16): c or u
  modified_base (22)..(22): c or u
  modified_base (29)..(29): c or u
  modified_base (49)..(49): c or u
  modified_base (58)..(58): c or u
  modified_base (81)..(81): c or u
  modified_base (83)..(83): c or u
  modified_base (85)..(85): c or u
  modified_base (90)..(90): c or u
  modified_base (93)..(93): c or u
  modified_base (100)..(100): c or u
  modified_base (104)..(104): c or u
  modified_base (110)..(110): c or u
  modified_base (137)..(137): c or u
  modified_base (151)..(151): c or u
  modified_base (161)..(161): c or u
  modified_base (165)..(165): c or u
  modified_base (172)..(172): c or u
  modified_base (184)..(184): c or u
  modified_base (195)..(195): c or u
  modified_base (205)..(205): c or u
  modified_base (214)..(214): c or u
  modified_base (219)..(219): c or u
  modified_base (224)..(224): c or u
  modified_base (226)..(226): c or u
  modified_base (237)..(237): c or u
  modified_base (245)..(245): c or u
  modified_base (250)..(250): c or u
  modified_base (253)..(253): c or u
  modified_base (260)..(260): c or u
  modified_base (268)..(268): c or u
  modified_base (271)..(271): c or u
  modified_base (274)..(274): c or u
  modified_base (288)..(288): c or u
  modified_base (290)..(290): c or u
  modified_base (297)..(297): c or u
guuuuuuaggautggngguuunggguuungutuuuauuuauuuauutanguagggggngtuutgutuagguaattuutuungngnguuungtnggggaungggnggggangggagaaggaaaaggguuuutggutungggauuagggutunggagggtgungggnggggagnggaauagggaangggutggtggngguuuuaagngggaggganggaungauangngguuuuutggngguuttgngautngungauutgnggaauutngtngunguuutuauaguuungngguuaunguu

SEQ ID NO: 28 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (10)..(10): c or u
  modified_base (12)..(12): c or u
  modified_base (26)..(26): c or u
  modified_base (29)..(29): c or u
  modified_base (32)..(32): c or u
  modified_base (40)..(40): c or u
  modified_base (47)..(47): c or u
  modified_base (50)..(50): c or u
  modified_base (55)..(55): c or u
  modified_base (63)..(63): c or u
  modified_base (74)..(74): c or u
  modified_base (76)..(76): c or u
  modified_base (81)..(81): c or u
  modified_base (86)..(86): c or u
  modified_base (95)..(95): c or u
  modified_base (105)..(105): c or u
  modified_base (116)..(116): c or u
  modified_base (128)..(128): c or u
  modified_base (135)..(135): c or u
  modified_base (139)..(139): c or u
  modified_base (149)..(149): c or u
  modified_base (163)..(163): c or u
  modified_base (190)..(190): c or u
  modified_base (196)..(196): c or u
  modified_base (200)..(200): c or u
  modified_base (207)..(207): c or u
  modified_base (210)..(210): c or u
  modified_base (215)..(215): c or u
  modified_base (217)..(217): c or u
  modified_base (219)..(219): c or u
  modified_base (242)..(242): c or u
  modified_base (251)..(251): c or u
  modified_base (271)..(271): c or u
  modified_base (278)..(278): c or u
  modified_base (284)..(284): c or u
ggnggtggungnggggutgtgagggnggngangaggttunguaggtnggngagtnguaaggunguuagggggungngtgtnggtungtuuutuunguttggggunguuauuaguungttuuutgttungutuuunguungguauuutunggaguuutggtuunggaguuagggguuuttttuuttutuungtuuunguunggtuuunganggggngngngggaggaattguutgaguagganguuuuutgngtaggtgggtgggtgggagngggguunggggunguuagtuutggggggu

SEQ ID NO: 29 - DNA, 300 bp, Artificial Sequence
  Description of Artificial Sequence: Synthetic oligonucleotide
  Description of Combined DNA/RNA Molecule: Synthetic oligonucleotide
  modified_base (75)..(75): c or u
  modified_base (77)..(77): c or u
  modified_base (90)..(90): c or u
  modified_base (94)..(94): c or u
  modified_base (120)..(120): c or u
  modified_base (130)..(130): c or u
  modified_base (145)..(145): c or u
  modified_base (150)..(150): c or u
  modified_base (167)..(167): c or u
  modified_base (180)..(180): c or u
  modified_base (193)..(193): c or u
  modified_base (206)..(206): c or u
  modified_base (215)..(215): c or u
  modified_base (240)..(240): c or u
  modified_base (244)..(244): c or u
  modified_base (255)..(255): c or u
aaaatgtttgguauutuattgatuatgtttagutgatuatuuutggggutggggaggguaguuagguuaguuagngnguaggguaggggngggnggaggagaaguutggaggaggutgangggaaguutngaggagggguauuunggtungaggutgggutgggaangutgutuuauagngutgtgagtggungggaggauttaunguuauuaungutguututgggguatutuuuauunguungggatgutgunguutuutttuuauaatguutgttgatuaattttttaatuaagaag

SEQ ID NO: 30 - DNA, 300 bp, Artificial Sequence
  Description of Artificial Sequence: Synthetic oligonucleotide
  Description of Combined DNA/RNA Molecule: Synthetic oligonucleotide
  modified_base (45)..(45): c or u
  modified_base (56)..(56): c or u
  modified_base (60)..(60): c or u
  modified_base (85)..(85): c or u
  modified_base (94)..(94): c or u
  modified_base (107)..(107): c or u
  modified_base (120)..(120): c or u
  modified_base (133)..(133): c or u
  modified_base (150)..(150): c or u
  modified_base (155)..(155): c or u
  modified_base (170)..(170): c or u
  modified_base (180)..(180): c or u
  modified_base (206)..(206): c or u
  modified_base (210)..(210): c or u
  modified_base (223)..(223): c or u
  modified_base (225)..(225): c or u
uttuttgattaaaaaattgatuaauagguattgtggaaaggaggngguaguatuungggngggtgggagatguuuuagagguagnggtggtggnggtaagtuutuungguuautuauagngutgtggaguagngttuuuaguuuaguutnggaunggggtguuuutuutngagguttuungtuaguutuutuuagguttutuutunguunguuuutguuutgngngutggutgguutggutguuutuuuuaguuuuagggatgatuagutaaauatgatuaatgaggtguuaaauatttt

SEQ ID NO: 31 - DNA, 300 bp, Artificial Sequence
  Description of Artificial Sequence: Synthetic oligonucleotide
  Description of Combined DNA/RNA Molecule: Synthetic oligonucleotide
  modified_base (11)..(11): c or u
  modified_base (24)..(24): c or u
  modified_base (51)..(51): c or u
  modified_base (61)..(61): c or u
  modified_base (70)..(70): c or u
  modified_base (88)..(88): c or u
  modified_base (90)..(90): c or u
  modified_base (108)..(108): c or u
  modified_base (127)..(127): c or u
  modified_base (131)..(131): c or u
  modified_base (141)..(141): c or u
  modified_base (150)..(150): c or u
  modified_base (164)..(164): c or u
  modified_base (169)..(169): c or u
  modified_base (172)..(172): c or u
  modified_base (174)..(174): c or u
  modified_base (185)..(185): c or u
  modified_base (190)..(190): c or u
  modified_base (197)..(197): c or u
  modified_base (202)..(202): c or u
  modified_base (205)..(205): c or u
  modified_base (208)..(208): c or u
  modified_base (214)..(214): c or u
  modified_base (227)..(227): c or u
  modified_base (240)..(240): c or u
  modified_base (255)..(255): c or u
  modified_base (274)..(274): c or u
  modified_base (291)..(291): c or u
gaguuuagttnguatututauagnguuauauatutagguuaguuuagutunggtuuuagtnggtututgnggaguuuuaguuagutungngtuttggtuutgguttgngggtgguauauagauaagngaunggggtgguunggagaggtngtguuuutggutgngagangangngauaguagggngutungggggunguagnggngtngaaggnggtuuutgggggnggggututgguangagggggauuutuungggtuaagttuauagaggnggagggguutgggutgnguuuuagag

SEQ ID NO: 32 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (26)..(26): c or u
  modified_base (45)..(45): c or u
  modified_base (60)..(60): c or u
  modified_base (73)..(73): c or u
  modified_base (86)..(86): c or u
  modified_base (92)..(92): c or u
  modified_base (95)..(95): c or u
  modified_base (98)..(98): c or u
  modified_base (103)..(103): c or u
  modified_base (110)..(110): c or u
  modified_base (115)..(115): c or u
  modified_base (126)..(126): c or u
  modified_base (128)..(128): c or u
  modified_base (131)..(131): c or u
  modified_base (136)..(136): c or u
  modified_base (150)..(150): c or u
  modified_base (159)..(159): c or u
  modified_base (169)..(169): c or u
  modified_base (173)..(173): c or u
  modified_base (192)..(192): c or u
  modified_base (210)..(210): c or u
  modified_base (212)..(212): c or u
  modified_base (230)..(230): c or u
  modified_base (239)..(239): c or u
  modified_base (249)..(249): c or u
  modified_base (276)..(276): c or u
  modified_base (289)..(289): c or u
ututggggnguaguuuagguuuutunguututgtgaauttgauungggagggtuuuuutngtguuagaguuunguuuuuagggaunguuttngangungutgngguuuunggagnguuutgutgtngngtngtutnguaguuagggguangauututunggguuauuunggtnguttgtutgtgtguuauunguaaguuaggauuaagangnggagutggutggggutunguagagaungautgggaunggagutgggutgguutagatgtgtggngutgtagagatgngaautgggutu

SEQ ID NO: 33 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (5)..(5): c or u
  modified_base (21)..(21): c or u
  modified_base (23)..(23): c or u
  modified_base (28)..(28): c or u
  modified_base (32)..(32): c or u
  modified_base (39)..(39): c or u
  modified_base (50)..(50): c or u
  modified_base (56)..(56): c or u
  modified_base (64)..(64): c or u
  modified_base (67)..(67): c or u
  modified_base (69)..(69): c or u
  modified_base (73)..(73): c or u
  modified_base (81)..(81): c or u
  modified_base (85)..(85): c or u
  modified_base (104)..(104): c or u
  modified_base (106)..(106): c or u
  modified_base (113)..(113): c or u
  modified_base (119)..(119): c or u
  modified_base (138)..(138): c or u
  modified_base (143)..(143): c or u
  modified_base (146)..(146): c or u
  modified_base (150)..(150): c or u
  modified_base (168)..(168): c or u
  modified_base (173)..(173): c or u
  modified_base (190)..(190): c or u
  modified_base (192)..(192): c or u
  modified_base (221)..(221): c or u
  modified_base (239)..(239): c or u
  modified_base (247)..(247): c or u
  modified_base (255)..(255): c or u
  modified_base (268)..(268): c or u
  modified_base (273)..(273): c or u
  modified_base (279)..(279): c or u
  modified_base (283)..(283): c or u
  modified_base (292)..(292): c or u
  modified_base (298)..(298): c or u
gnggngggggutgututgggngnguuungggngaagtgnguuuagtutungguuungguuuutnggngnguungauttuunggunguuuutgaguuuaguagungngggtuungggatnggutaagagtagutguaanguutngungganggagtuutttuutttuungggangutggguuatgagutungngguuauutgagguauaggggagtutgutngguuaggauaguutuuungaagtuungtguuutnguututguautgnggganguuagngutngguuutggnggaggngt

SEQ ID NO: 34 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (8)..(8): c or u
  modified_base (17)..(17): c or u
  modified_base (21)..(21): c or u
  modified_base (27)..(27): c or u
  modified_base (32)..(32): c or u
  modified_base (45)..(45): c or u
  modified_base (53)..(53): c or u
  modified_base (61)..(61): c or u
  modified_base (79)..(79): c or u
  modified_base (108)..(108): c or u
  modified_base (110)..(110): c or u
  modified_base (127)..(127): c or u
  modified_base (132)..(132): c or u
  modified_base (150)..(150): c or u
  modified_base (154)..(154): c or u
  modified_base (157)..(157): c or u
  modified_base (162)..(162): c or u
  modified_base (181)..(181): c or u
  modified_base (187)..(187): c or u
  modified_base (194)..(194): c or u
  modified_base (196)..(196): c or u
  modified_base (215)..(215): c or u
  modified_base (219)..(219): c or u
  modified_base (227)..(227): c or u
  modified_base (231)..(231): c or u
  modified_base (233)..(233): c or u
  modified_base (236)..(236): c or u
  modified_base (244)..(244): c or u
  modified_base (250)..(250): c or u
  modified_base (261)..(261): c or u
  modified_base (268)..(268): c or u
  modified_base (272)..(272): c or u
  modified_base (277)..(277): c or u
  modified_base (279)..(279): c or u
  modified_base (295)..(295): c or u
  modified_base (298)..(298): c or u
anguutunguuagggungagngutggngtuunguagtguagaggngaggguangggauttnggggaggutgtuutggungaguagautuuuutgtguutuaggtggungnggagutuatgguuuagngtuungggaaaggaaaggautungtunggngaggngttguagutaututtagungatuungggauungnggutgutgggutuaggggnggungggaagtngggngngungaggggunggggunggagautgggnguauttnguunggggngnguuuagaguaguuuungungu

SEQ ID NO: 35 - DNA, 300 bp, Artificial Sequence
  Description of Artificial Sequence: Synthetic oligonucleotide
  Description of Combined DNA/RNA Molecule: Synthetic oligonucleotide
  modified_base (46)..(46): c or u
  modified_base (48)..(48): c or u
  modified_base (65)..(65): c or u
  modified_base (68)..(68): c or u
  modified_base (99)..(99): c or u
  modified_base (103)..(103): c or u
  modified_base (117)..(117): c or u
  modified_base (123)..(123): c or u
  modified_base (150)..(150): c or u
  modified_base (162)..(162): c or u
  modified_base (166)..(166): c or u
  modified_base (243)..(243): c or u
  modified_base (263)..(263): c or u
  modified_base (293)..(293): c or u
aaatggtgaaatatuututaaaaatatgttuuuuaagguuaauttngnggutggtaguuuuttunganguutttguutuuuagaaaatuauaauaaagngatnggaaattuaguuanggtuungggaagaaggagtaguagtgagguuunggaauuuautgnggungaaautguuatgutututttaauuaaaataaaaaagataagaagaagaagtaaaauuutttaatauatuaaatatanggaattttaatutttaaagngatauattgtutattattttagtauatgangtaaauu

SEQ ID NO: 36 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (37)..(37): c or u
  modified_base (57)..(57): c or u
  modified_base (134)..(134): c or u
  modified_base (138)..(138): c or u
  modified_base (150)..(150): c or u
  modified_base (177)..(177): c or u
  modified_base (183)..(183): c or u
  modified_base (197)..(197): c or u
  modified_base (201)..(201): c or u
  modified_base (232)..(232): c or u
  modified_base (235)..(235): c or u
  modified_base (252)..(252): c or u
  modified_base (254)..(254): c or u
ggtttangtuatgtautaaaataatagauaatgtatngutttaaagattaaaattungtatatttgatgtattaaagggttttauttuttuttuttatuttttttattttggttaaagagaguatgguagtttnggunguagtgggttungggguutuautgutautuuttuttuungggaungtggutgaatttungatngutttgttgtgattttutgggagguaaaggngtnggaaggggutauuagungngaagttgguuttggggaauatatttttagaggatatttuauuattt

SEQ ID NO: 37 - DNA, 300 bp, Artificial Sequence
  Description of Artificial Sequence: Synthetic oligonucleotide
  Description of Combined DNA/RNA Molecule: Synthetic oligonucleotide
  modified_base (16)..(16): c or u
  modified_base (112)..(112): c or u
  modified_base (120)..(120): c or u
  modified_base (129)..(129): c or u
  modified_base (135)..(135): c or u
  modified_base (151)..(151): c or u
  modified_base (167)..(167): c or u
  modified_base (203)..(203): c or u
  modified_base (222)..(222): c or u
  modified_base (262)..(262): c or u
  modified_base (276)..(276): c or u
gtgguaggggtaaggnguttuuatttguutgaaaggututguuutauauaaaaatagaaautggttguatguatguaaaggatggutgagtggtaataautggaggaautgnggauagunggaggutgnggggunggagggtutttgggtnggtaututguuuuaunggaggtuuauaggguutuutuuatuuagggtgggungguaagtutguutatuagngatutggguaaguutgutautttttatgauutuauttgungaaautuaaguuanguutgggtaagtauattutguaua

SEQ ID NO: 38 - DNA, 300 bp, Artificial Sequence
  Description of Artificial Sequence: Synthetic oligonucleotide
  Description of Combined DNA/RNA Molecule: Synthetic oligonucleotide
  modified_base (24)..(24): c or u
  modified_base (38)..(38): c or u
  modified_base (78)..(78): c or u
  modified_base (97)..(97): c or u
  modified_base (133)..(133): c or u
  modified_base (149)..(149): c or u
  modified_base (165)..(165): c or u
  modified_base (171)..(171): c or u
  modified_base (180)..(180): c or u
  modified_base (188)..(188): c or u
  modified_base (284)..(284): c or u
tgtguagaatgtauttauuuaggngtgguttgagtttngguaagtgaggtuataaaaagtaguagguttguuuagatngutgatagguagauttgungguuuauuutggatggaggagguuutgtggauutunggtgggguagagtaungauuuaaagauuutungguuunguaguutunggutgtunguagttuutuuagttattauuautuaguuatuutttguatguatguaauuagtttutatttttgtgtaggguagaguutttuagguaaatggaagnguuttauuuutguuau

SEQ ID NO: 39 - DNA, 300 bp, Artificial Sequence
  Description of Artificial Sequence: Synthetic oligonucleotide
  Description of Combined DNA/RNA Molecule: Synthetic oligonucleotide
  modified_base (17)..(17): c or u
  modified_base (21)..(21): c or u
  modified_base (80)..(80): c or u
  modified_base (94)..(94): c or u
  modified_base (114)..(114): c or u
  modified_base (128)..(128): c or u
  modified_base (151)..(151): c or u
  modified_base (161)..(161): c or u
  modified_base (165)..(165): c or u
  modified_base (202)..(202): c or u
  modified_base (215)..(215): c or u
  modified_base (218)..(218): c or u
  modified_base (238)..(238): c or u
  modified_base (270)..(270): c or u
  modified_base (296)..(296): c or u
aututggaagtgtguanggungttgtguagggtggatggtgttgauuttttgauutgaaaauagttgggggutggggagnggaggaaggatggnggaagagaggaaagaguuangagaauaautaggngggatgtauttttgaguuutgungggtgtutungatnggagtutggggttgagatttgggutguauttgtuuunggtgtgtututunggnggagtauuutgaaggtguangaggtggggaguataggutgaggtgggtaatngggtuutggatagaaauauaauuutngtuu

SEQ ID NO: 40 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (30)..(30): c or u
  modified_base (62)..(62): c or u
  modified_base (82)..(82): c or u
  modified_base (85)..(85): c or u
  modified_base (98)..(98): c or u
  modified_base (135)..(135): c or u
  modified_base (139)..(139): c or u
  modified_base (149)..(149): c or u
  modified_base (172)..(172): c or u
  modified_base (186)..(186): c or u
  modified_base (206)..(206): c or u
  modified_base (220)..(220): c or u
  modified_base (279)..(279): c or u
  modified_base (283)..(283): c or u
ggangagggttgtgtttutatuuaggauungattauuuauutuaguutatgutuuuuauutngtguauuttuagggtautungunggagagauauaunggggauaagtguaguuuaaatutuaauuuuagautungatnggagauauungguagggutuaaaagtauatuunguutagttgttutngtggututttuutututtunguuatuuttuutungutuuuuaguuuuuaautgttttuaggtuaaaaggtuaauauuatuuauuutguauaanggungtguauauttuuagagt

SEQ ID NO: 41 - DNA, 300 bp, Artificial Sequence
  Description of Artificial Sequence: Synthetic oligonucleotide
  Description of Combined DNA/RNA Molecule: Synthetic oligonucleotide
  modified_base (20)..(20): c or u
  modified_base (23)..(23): c or u
  modified_base (38)..(38): c or u
  modified_base (48)..(48): c or u
  modified_base (63)..(63): c or u
  modified_base (75)..(75): c or u
  modified_base (79)..(79): c or u
  modified_base (81)..(81): c or u
  modified_base (84)..(84): c or u
  modified_base (87)..(87): c or u
  modified_base (108)..(108): c or u
  modified_base (119)..(119): c or u
  modified_base (129)..(129): c or u
  modified_base (137)..(137): c or u
  modified_base (139)..(139): c or u
  modified_base (144)..(144): c or u
  modified_base (150)..(150): c or u
  modified_base (152)..(152): c or u
  modified_base (156)..(156): c or u
  modified_base (160)..(160): c or u
  modified_base (169)..(169): c or u
  modified_base (171)..(171): c or u
  modified_base (174)..(174): c or u
  modified_base (186)..(186): c or u
  modified_base (201)..(201): c or u
  modified_base (235)..(235): c or u
  modified_base (246)..(246): c or u
  modified_base (251)..(251): c or u
  modified_base (254)..(254): c or u
  modified_base (259)..(259): c or u
  modified_base (261)..(261): c or u
  modified_base (264)..(264): c or u
  modified_base (278)..(278): c or u
  modified_base (286)..(286): c or u
  modified_base (290)..(290): c or u
  modified_base (292)..(292): c or u
aaagauttggttuuagaaungunguaauaagtggaagngguagututnggutgagutggaggngguuaauatggnguangngtnggnguagaututggtgaguatgungutggtgttungggauagttngutgutgngngtgunggtgungngutngutnguutttuungngungututautauungggaaguaauututngguuttauutututauaauutatauaauaagutngautautgaungguungunguuungngunguuuuuagutguunguagagungggngngtautgta

SEQ ID NO: 42 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (10)..(10): c or u
  modified_base (14)..(14): c or u
  modified_base (22)..(22): c or u
  modified_base (36)..(36): c or u
  modified_base (39)..(39): c or u
  modified_base (41)..(41): c or u
  modified_base (46)..(46): c or u
  modified_base (49)..(49): c or u
  modified_base (54)..(54): c or u
  modified_base (65)..(65): c or u
  modified_base (99)..(99): c or u
  modified_base (114)..(114): c or u
  modified_base (126)..(126): c or u
  modified_base (129)..(129): c or u
  modified_base (131)..(131): c or u
  modified_base (140)..(140): c or u
  modified_base (144)..(144): c or u
  modified_base (148)..(148): c or u
  modified_base (150)..(150): c or u
  modified_base (156)..(156): c or u
  modified_base (161)..(161): c or u
  modified_base (163)..(163): c or u
  modified_base (171)..(171): c or u
  modified_base (181)..(181): c or u
  modified_base (192)..(192): c or u
  modified_base (213)..(213): c or u
  modified_base (216)..(216): c or u
  modified_base (219)..(219): c or u
  modified_base (221)..(221): c or u
  modified_base (225)..(225): c or u
  modified_base (237)..(237): c or u
  modified_base (252)..(252): c or u
  modified_base (262)..(262): c or u
  modified_base (277)..(277): c or u
  modified_base (280)..(280): c or u
tauagtangnguunggututgnggguagutgggggnggngnggggnggngggunggtuagtagtngaguttgttgtataggttgtagagaggtaaggungagaggttguttuungggtagtagagnggngngggaaaggngagngagngngguaungguangnguaguagngaautgtuunggaauauuagngguatgutuauuagagtutgngungangngtgnguuatgttggunguutuuagutuagungagagutgunguttuuauttgttgnggnggttutggaauuaagtuttt

SEQ ID NO: 43 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (14)..(14): c or u
  modified_base (24)..(24): c or u
  modified_base (36)..(36): c or u
  modified_base (39)..(39): c or u
  modified_base (42)..(42): c or u
  modified_base (54)..(54): c or u
  modified_base (58)..(58): c or u
  modified_base (60)..(60): c or u
  modified_base (65)..(65): c or u
  modified_base (67)..(67): c or u
  modified_base (72)..(72): c or u
  modified_base (88)..(88): c or u
  modified_base (107)..(107): c or u
  modified_base (113)..(113): c or u
  modified_base (118)..(118): c or u
  modified_base (120)..(120): c or u
  modified_base (123)..(123): c or u
  modified_base (125)..(125): c or u
  modified_base (133)..(133): c or u
  modified_base (137)..(137): c or u
  modified_base (145)..(145): c or u
  modified_base (150)..(150): c or u
  modified_base (152)..(152): c or u
  modified_base (155)..(155): c or u
  modified_base (157)..(157): c or u
  modified_base (164)..(164): c or u
  modified_base (169)..(169): c or u
  modified_base (172)..(172): c or u
  modified_base (186)..(186): c or u
  modified_base (190)..(190): c or u
  modified_base (194)..(194): c or u
  modified_base (197)..(197): c or u
  modified_base (201)..(201): c or u
  modified_base (257)..(257): c or u
uuagnguauaguungguuaggggnguuutuuutgungungungguuutttgatnguungngguungngguunguagauuauaguuagngutgtgutggguaggtggngguagnggggngnggngngutuaggnguangggtuuungggungnggngngutuuunguuangunguauatuaagguunggunggunggngggnguuttuattaguaguutgaaattataatattatgttaaagaauaaagutgutuuunggaaaaatatgtgutguatatutgauaaagataaattggatta

SEQ ID NO: 44 - DNA, 300 bp, Artificial Sequence
  Description of Artificial Sequence: Synthetic oligonucleotide
  Description of Combined DNA/RNA Molecule: Synthetic oligonucleotide
  modified_base (43)..(43): c or u
  modified_base (99)..(99): c or u
  modified_base (103)..(103): c or u
  modified_base (106)..(106): c or u
  modified_base (110)..(110): c or u
  modified_base (114)..(114): c or u
  modified_base (128)..(128): c or u
  modified_base (131)..(131): c or u
  modified_base (136)..(136): c or u
  modified_base (143)..(143): c or u
  modified_base (145)..(145): c or u
  modified_base (148)..(148): c or u
  modified_base (150)..(150): c or u
  modified_base (155)..(155): c or u
  modified_base (163)..(163): c or u
  modified_base (167)..(167): c or u
  modified_base (175)..(175): c or u
  modified_base (177)..(177): c or u
  modified_base (180)..(180): c or u
  modified_base (182)..(182): c or u
  modified_base (187)..(187): c or u
  modified_base (193)..(193): c or u
  modified_base (212)..(212): c or u
  modified_base (228)..(228): c or u
  modified_base (233)..(233): c or u
  modified_base (235)..(235): c or u
  modified_base (240)..(240): c or u
  modified_base (242)..(242): c or u
  modified_base (246)..(246): c or u
  modified_base (258)..(258): c or u
  modified_base (261)..(261): c or u
  modified_base (264)..(264): c or u
  modified_base (276)..(276): c or u
  modified_base (286)..(286): c or u
  modified_base (295)..(295): c or u
taatuuaatttatutttgtuagatatguaguauatatttttunggggaguagutttgttutttaauataatattataatttuaggutgutaatgaaggnguungunggunggunggguuttgatgtgnggngtggnggggagngngungngguunggggauungtgnguutgagngngungnguuungutgunguuauutguuuaguauagngutggutgtggtutgngggungngggungngggngatuaaagggunggnggngguagggagggnguuuutggungggutgtgngutgg

SEQ ID NO: 45 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (7)..(7): c or u
  modified_base (18)..(18): c or u
  modified_base (25)..(25): c or u
  modified_base (30)..(30): c or u
  modified_base (41)..(41): c or u
  modified_base (43)..(43): c or u
  modified_base (48)..(48): c or u
  modified_base (63)..(63): c or u
  modified_base (69)..(69): c or u
  modified_base (72)..(72): c or u
  modified_base (80)..(80): c or u
  modified_base (82)..(82): c or u
  modified_base (90)..(90): c or u
  modified_base (97)..(97): c or u
  modified_base (106)..(106): c or u
  modified_base (111)..(111): c or u
  modified_base (119)..(119): c or u
  modified_base (128)..(128): c or u
  modified_base (133)..(133): c or u
  modified_base (137)..(137): c or u
  modified_base (145)..(145): c or u
  modified_base (151)..(151): c or u
  modified_base (157)..(157): c or u
  modified_base (168)..(168): c or u
  modified_base (173)..(173): c or u
  modified_base (178)..(178): c or u
  modified_base (184)..(184): c or u
  modified_base (189)..(189): c or u
  modified_base (200)..(200): c or u
  modified_base (202)..(202): c or u
  modified_base (205)..(205): c or u
  modified_base (214)..(214): c or u
  modified_base (219)..(219): c or u
  modified_base (222)..(222): c or u
  modified_base (228)..(228): c or u
  modified_base (231)..(231): c or u
  modified_base (239)..(239): c or u
  modified_base (267)..(267): c or u
  modified_base (272)..(272): c or u
  modified_base (274)..(274): c or u
  modified_base (282)..(282): c or u
  modified_base (288)..(288): c or u
  modified_base (294)..(294): c or u
ungtuungggutuutggnggutgtngutgnggttuuttuungngggunggguuuuttuuutgnguuttngunguutuutngnguutguungggguunguaguutunguaungggaauunggaggauungaggngggnguaggggngaagunggggunggggaggggunguutngutungggttngaganggaagaaauangnggnguaggutunggagnganggutunganggggauungttaaataatttattgatgatauaaagngautngnguuuauunggggunguuuunggattu

SEQ ID NO: 46 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (12)..(12): c or u
  modified_base (18)..(18): c or u
  modified_base (26)..(26): c or u
  modified_base (28)..(28): c or u
  modified_base (33)..(33): c or u
  modified_base (61)..(61): c or u
  modified_base (69)..(69): c or u
  modified_base (72)..(72): c or u
  modified_base (78)..(78): c or u
  modified_base (81)..(81): c or u
  modified_base (86)..(86): c or u
  modified_base (95)..(95): c or u
  modified_base (98)..(98): c or u
  modified_base (100)..(100): c or u
  modified_base (111)..(111): c or u
  modified_base (116)..(116): c or u
  modified_base (122)..(122): c or u
  modified_base (127)..(127): c or u
  modified_base (132)..(132): c or u
  modified_base (143)..(143): c or u
  modified_base (149)..(149): c or u
  modified_base (155)..(155): c or u
  modified_base (163)..(163): c or u
  modified_base (167)..(167): c or u
  modified_base (172)..(172): c or u
  modified_base (181)..(181): c or u
  modified_base (189)..(189): c or u
  modified_base (194)..(194): c or u
  modified_base (203)..(203): c or u
  modified_base (210)..(210): c or u
  modified_base (218)..(218): c or u
  modified_base (220)..(220): c or u
  modified_base (228)..(228): c or u
  modified_base (231)..(231): c or u
  modified_base (237)..(237): c or u
  modified_base (252)..(252): c or u
  modified_base (257)..(257): c or u
  modified_base (259)..(259): c or u
  modified_base (270)..(270): c or u
  modified_base (275)..(275): c or u
  modified_base (282)..(282): c or u
  modified_base (293)..(293): c or u
  modified_base (298)..(298): c or u
gaatungggggngguuungggtgggngngagtngutttgtatuatuaataaattatttaangggtuuungtnggagungtngutunggaguutgngungngtgtttuttungtutngaauunggagngaggngguuuutuuungguuungguttnguuuutgnguunguutngggtuutungggttuunggtgnggaggutgnggguuunggguaggngngaggaggnggngaaggnguagggaagggguungguungngggaaggaaunguagngauagunguuaggaguungggangg

SEQ ID NO: 47 - DNA, 300 bp, Artificial Sequence
  Description of Artificial Sequence: Synthetic oligonucleotide
  Description of Combined DNA/RNA Molecule: Synthetic oligonucleotide
  modified_base (12)..(12): c or u
  modified_base (15)..(15): c or u
  modified_base (18)..(18): c or u
  modified_base (22)..(22): c or u
  modified_base (57)..(57): c or u
  modified_base (61)..(61): c or u
  modified_base (64)..(64): c or u
  modified_base (77)..(77): c or u
  modified_base (79)..(79): c or u
  modified_base (87)..(87): c or u
  modified_base (92)..(92): c or u
  modified_base (101)..(101): c or u
  modified_base (103)..(103): c or u
  modified_base (105)..(105): c or u
  modified_base (118)..(118): c or u
  modified_base (131)..(131): c or u
  modified_base (133)..(133): c or u
  modified_base (148)..(148): c or u
  modified_base (150)..(150): c or u
  modified_base (162)..(162): c or u
  modified_base (165)..(165): c or u
  modified_base (181)..(181): c or u
  modified_base (185)..(185): c or u
  modified_base (190)..(190): c or u
  modified_base (198)..(198): c or u
  modified_base (219)..(219): c or u
  modified_base (221)..(221): c or u
  modified_base (223)..(223): c or u
  modified_base (231)..(231): c or u
  modified_base (235)..(235): c or u
  modified_base (237)..(237): c or u
  modified_base (243)..(243): c or u
  modified_base (252)..(252): c or u
  modified_base (255)..(255): c or u
  modified_base (258)..(258): c or u
  modified_base (262)..(262): c or u
  modified_base (265)..(265): c or u
  modified_base (267)..(267): c or u
  modified_base (273)..(273): c or u
  modified_base (281)..(281): c or u
uttgtuuaggangungunggunggggutguaagggaggggaagggagggaggtuagnggunggnggggtuuuuutungnguuuauunguuunguauuuuungngnggguuautuauunggguuaguuagangngggtuuutuuagggngnguuutguauuangunggguuagaagatgggngggnguuungguagutngguuagggguttggggtagungngnguuauagnggungnggguungaagtaaangunggnggangangngaguungttgagungggguaguuuuuuuaggag

SEQ ID NO: 48 - DNA, 300 bp, Artificial Sequence
  Description of Artificial Sequence: Synthetic oligonucleotide
  Description of Combined DNA/RNA Molecule: Synthetic oligonucleotide
  modified_base (19)..(19): c or u
  modified_base (27)..(27): c or u
  modified_base (33)..(33): c or u
  modified_base (35)..(35): c or u
  modified_base (38)..(38): c or u
  modified_base (42)..(42): c or u
  modified_base (45)..(45): c or u
  modified_base (48)..(48): c or u
  modified_base (57)..(57): c or u
  modified_base (63)..(63): c or u
  modified_base (65)..(65): c or u
  modified_base (69)..(69): c or u
  modified_base (77)..(77): c or u
  modified_base (79)..(79): c or u
  modified_base (81)..(81): c or u
  modified_base (102)..(102): c or u
  modified_base (110)..(110): c or u
  modified_base (115)..(115): c or u
  modified_base (119)..(119): c or u
  modified_base (135)..(135): c or u
  modified_base (138)..(138): c or u
  modified_base (150)..(150): c or u
  modified_base (152)..(152): c or u
  modified_base (167)..(167): c or u
  modified_base (169)..(169): c or u
  modified_base (182)..(182): c or u
  modified_base (195)..(195): c or u
  modified_base (197)..(197): c or u
  modified_base (199)..(199): c or u
  modified_base (208)..(208): c or u
  modified_base (213)..(213): c or u
  modified_base (221)..(221): c or u
  modified_base (223)..(223): c or u
  modified_base (236)..(236): c or u
  modified_base (239)..(239): c or u
  modified_base (243)..(243): c or u
  modified_base (278)..(278): c or u
  modified_base (282)..(282): c or u
  modified_base (285)..(285): c or u
  modified_base (288)..(288): c or u
utuutgggggggutguuunggutuaangggutngngtngtungunggngtttauttnggguungnggungutgtggngngnggutauuuuaaguuuutggungagutgunggggnguunguuuatuttutgguunggngtggtguagggngnguuutggagggauungngtutggutgguungggtgagtgguungngnggggggtgnggggngggtgggngnggagggggauuungunggungutgauutuuutuuuttuuuutuuuttguaguuunggunggnggngtuutggauaag

SEQ ID NO: 49 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (19)..(19): c or u
  modified_base (55)..(55): c or u
  modified_base (67)..(67): c or u
  modified_base (87)..(87): c or u
  modified_base (94)..(94): c or u
  modified_base (105)..(105): c or u
  modified_base (107)..(107): c or u
  modified_base (113)..(113): c or u
  modified_base (122)..(122): c or u
  modified_base (132)..(132): c or u
  modified_base (143)..(143): c or u
  modified_base (148)..(148): c or u
  modified_base (150)..(150): c or u
  modified_base (157)..(157): c or u
  modified_base (213)..(213): c or u
  modified_base (220)..(220): c or u
  modified_base (269)..(269): c or u
  modified_base (297)..(297): c or u
utungguutuatuttutungtggaggtguuuttuaguaagtttguuaauaauaungaggguuagtgnggtgagguuauagggutuunggguatngtutgguattngngggggngggggtgunggguaggggngagguuauuangtgungngtgtgunggtgtututgutttutggutgututgutgagtguagguuauagguatgagguttanguutgunggtauutguagutuuuuagtauuatagggautgtuuuagggttgttutngggggauagtgagguauagguaggguungut

SEQ ID NO: 50 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (31)..(31): c or u
  modified_base (80)..(80): c or u
  modified_base (87)..(87): c or u
  modified_base (143)..(143): c or u
  modified_base (150)..(150): c or u
  modified_base (152)..(152): c or u
  modified_base (157)..(157): c or u
  modified_base (168)..(168): c or u
  modified_base (178)..(178): c or u
  modified_base (187)..(187): c or u
  modified_base (193)..(193): c or u
  modified_base (195)..(195): c or u
  modified_base (206)..(206): c or u
  modified_base (213)..(213): c or u
  modified_base (233)..(233): c or u
  modified_base (245)..(245): c or u
  modified_base (281)..(281): c or u
  modified_base (296)..(296): c or u
agnggguuutguutgtguutuautgtuuuungagaauaauuutgggauagtuuutatggtautggggagutguaggtaungguaggngtaaguutuatguutgtgguutguautuaguagaguaguuagaaaguagagauaungguauangngguangtggtgguutnguuuutguungguauuuunguuuungngaatguuagangatguungggaguuutgtgguutuaunguautgguuutnggtgttgttgguaaauttgutgaaggguauutuuanggagaagatgaggunggag

SEQ ID NO: 51 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (7)..(7): c or u
  modified_base (24)..(24): c or u
  modified_base (36)..(36): c or u
  modified_base (47)..(47): c or u
  modified_base (64)..(64): c or u
  modified_base (80)..(80): c or u
  modified_base (97)..(97): c or u
  modified_base (110)..(110): c or u
  modified_base (117)..(117): c or u
  modified_base (119)..(119): c or u
  modified_base (141)..(141): c or u
  modified_base (144)..(144): c or u
  modified_base (150)..(150): c or u
  modified_base (155)..(155): c or u
  modified_base (165)..(165): c or u
  modified_base (172)..(172): c or u
  modified_base (184)..(184): c or u
  modified_base (191)..(191): c or u
  modified_base (194)..(194): c or u
  modified_base (198)..(198): c or u
  modified_base (200)..(200): c or u
  modified_base (203)..(203): c or u
  modified_base (210)..(210): c or u
  modified_base (224)..(224): c or u
  modified_base (234)..(234): c or u
  modified_base (237)..(237): c or u
  modified_base (244)..(244): c or u
  modified_base (262)..(262): c or u
  modified_base (266)..(266): c or u
  modified_base (272)..(272): c or u
  modified_base (283)..(283): c or u
  modified_base (293)..(293): c or u
uuaungngguuttttuauuuaaunguuuuutuutgngtggggguuunguatuuuutggautggngtgggututgggguungatguuutgguaguuungguuatututgungutggungngggtauutgutuauutgtuuangungtggungauunggggatuaungauagunggguuatguutngagtuungunguungngungutgutngguttutuagaaanguauutuuangunguuagunggggutuuagggtuuaunguunggguunggaggautggngautuuutungaggttg

SEQ ID NO: 52 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (17)..(17): c or u
  modified_base (28)..(28): c or u
  modified_base (34)..(34): c or u
  modified_base (38)..(38): c or u
  modified_base (56)..(56): c or u
  modified_base (63)..(63): c or u
  modified_base (66)..(66): c or u
  modified_base (76)..(76): c or u
  modified_base (90)..(90): c or u
  modified_base (97)..(97): c or u
  modified_base (100)..(100): c or u
  modified_base (102)..(102): c or u
  modified_base (106)..(106): c or u
  modified_base (109)..(109): c or u
  modified_base (116)..(116): c or u
  modified_base (128)..(128): c or u
  modified_base (135)..(135): c or u
  modified_base (145)..(145): c or u
  modified_base (150)..(150): c or u
  modified_base (156)..(156): c or u
  modified_base (159)..(159): c or u
  modified_base (181)..(181): c or u
  modified_base (183)..(183): c or u
  modified_base (190)..(190): c or u
  modified_base (203)..(203): c or u
  modified_base (220)..(220): c or u
  modified_base (236)..(236): c or u
  modified_base (253)..(253): c or u
  modified_base (264)..(264): c or u
  modified_base (276)..(276): c or u
  modified_base (293)..(293): c or u
  modified_base (295)..(295): c or u
uaauutnggagggagtnguuagtuutunggguungggnggtggauuutggaguuunggutggnggngtggaggtgngtttutgagaagungaguagnggngngggnggngggautngagguatgguunggutgtnggtgatuuungggtngguuanggngtggauaggtgaguaggtauungngguuagngguagagatggunggggutguuaggguatnggguuuuagaguuuanguuagtuuaggggatgngggguuuuuanguaggagggggnggttgggtgaaaaggungnggtgg

SEQ ID NO: 53 - DNA, 300 bp, Artificial Sequence
  Description of Artificial Sequence: Synthetic oligonucleotide
  Description of Combined DNA/RNA Molecule: Synthetic oligonucleotide
  modified_base (20)..(20): c or u
  modified_base (26)..(26): c or u
  modified_base (36)..(36): c or u
  modified_base (45)..(45): c or u
  modified_base (48)..(48): c or u
  modified_base (60)..(60): c or u
  modified_base (69)..(69): c or u
  modified_base (82)..(82): c or u
  modified_base (85)..(85): c or u
  modified_base (99)..(99): c or u
  modified_base (115)..(115): c or u
  modified_base (128)..(128): c or u
  modified_base (135)..(135): c or u
  modified_base (150)..(150): c or u
  modified_base (154)..(154): c or u
  modified_base (160)..(160): c or u
  modified_base (164)..(164): c or u
  modified_base (172)..(172): c or u
  modified_base (193)..(193): c or u
  modified_base (206)..(206): c or u
  modified_base (218)..(218): c or u
  modified_base (222)..(222): c or u
  modified_base (233)..(233): c or u
  modified_base (243)..(243): c or u
  modified_base (256)..(256): c or u
  modified_base (291)..(291): c or u
atgutagtguagttuuutgnguagunguuaggtggngtuaaggungunguutggggggunggguaggungagguuuutguungtnguagtuuuaguutngutuauuauttgguungggagttggutgnggguagngguttgguaguutgnggungggggngganggtggggnggtgtgggtttuaguutuuunggaggguuutuanggutgaguaaangttngggutgatgtngguaauatgnggaatuaattttnggggaautuaguaguuaaauuatuuauutttgggngggaaguag

SEQ ID NO: 54 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (44)..(44): c or u
  modified_base (57)..(57): c or u
  modified_base (67)..(67): c or u
  modified_base (78)..(78): c or u
  modified_base (82)..(82): c or u
  modified_base (94)..(94): c or u
  modified_base (107)..(107): c or u
  modified_base (128)..(128): c or u
  modified_base (136)..(136): c or u
  modified_base (140)..(140): c or u
  modified_base (146)..(146): c or u
  modified_base (150)..(150): c or u
  modified_base (165)..(165): c or u
  modified_base (172)..(172): c or u
  modified_base (185)..(185): c or u
  modified_base (201)..(201): c or u
  modified_base (215)..(215): c or u
  modified_base (218)..(218): c or u
  modified_base (231)..(231): c or u
  modified_base (240)..(240): c or u
  modified_base (252)..(252): c or u
  modified_base (255)..(255): c or u
  modified_base (264)..(264): c or u
  modified_base (274)..(274): c or u
  modified_base (280)..(280): c or u
utguttuunguuuaaaggtggatggtttggutgutgagttuuungaaaattgattunguatgttgungauatuaguungaangtttgutuagungtgaggguuutunggggaggutgaaauuuauaunguuuuaungtunguuuunggunguaggutguuaagungutguunguaguuaautuunggguuaagtggtgagngaggutgggautgnganggguagggguutngguutguungguuuuuuaggnggngguuttganguuauutggnggutgnguagggaautguautaguat

SEQ ID NO: 55 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (10)..(10): c or u
  modified_base (27)..(27): c or u
  modified_base (31)..(31): c or u
  modified_base (34)..(34): c or u
  modified_base (40)..(40): c or u
  modified_base (42)..(42): c or u
  modified_base (49)..(49): c or u
  modified_base (52)..(52): c or u
  modified_base (90)..(90): c or u
  modified_base (96)..(96): c or u
  modified_base (102)..(102): c or u
  modified_base (108)..(108): c or u
  modified_base (113)..(113): c or u
  modified_base (115)..(115): c or u
  modified_base (141)..(141): c or u
  modified_base (151)..(151): c or u
  modified_base (155)..(155): c or u
  modified_base (166)..(166): c or u
  modified_base (172)..(172): c or u
  modified_base (209)..(209): c or u
  modified_base (212)..(212): c or u
  modified_base (222)..(222): c or u
  modified_base (276)..(276): c or u
  modified_base (296)..(296): c or u
ggagnggtgnggagguaguuagguuunguungunguagungngguagungunggaggattuutgtuutaatatggagutgggattuuuungguuunguuuunguuuungguungnggggagauagaggutgguaguagggnggggggaagngutnguttgggggungguaanggggggaagggatguutaagtguagauuuaggtuutngungtguuuuuangtuuutguutuagtttuuuuttuagtaaggttaattagutgagagggaaauuangaatuautguagautauagngutg

SEQ ID NO: 56 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (24)..(24): c or u
  modified_base (78)..(78): c or u
  modified_base (88)..(88): c or u
  modified_base (91)..(91): c or u
  modified_base (128)..(128): c or u
  modified_base (134)..(134): c or u
  modified_base (145)..(145): c or u
  modified_base (149)..(149): c or u
  modified_base (159)..(159): c or u
  modified_base (185)..(185): c or u
  modified_base (187)..(187): c or u
  modified_base (192)..(192): c or u
  modified_base (198)..(198): c or u
  modified_base (204)..(204): c or u
  modified_base (210)..(210): c or u
  modified_base (248)..(248): c or u
  modified_base (251)..(251): c or u
  modified_base (258)..(258): c or u
  modified_base (260)..(260): c or u
  modified_base (266)..(266): c or u
  modified_base (269)..(269): c or u
  modified_base (273)..(273): c or u
  modified_base (290)..(290): c or u
  modified_base (295)..(295): c or u
uagngutgtagtutguagtgattngtggtttuuututuagutaattaauuttautgaaggggaaautgagguagggangtggggguanggngaggauutgggtutguauttagguatuuuttuuuuungttgungguuuuuaagngagnguttuuuuunguuutgutguuaguututgtutuuungngggungggggngggggnggggungggggaatuuuagutuuatattaggauaggaatuutunggnggutgungnggutgnggngggngggguutggutguutunguaungutuu

SEQ ID NO: 57 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (25)..(25): c or u
  modified_base (38)..(38): c or u
  modified_base (43)..(43): c or u
  modified_base (65)..(65): c or u
  modified_base (78)..(78): c or u
  modified_base (80)..(80): c or u
  modified_base (88)..(88): c or u
  modified_base (91)..(91): c or u
  modified_base (115)..(115): c or u
  modified_base (120)..(120): c or u
  modified_base (126)..(126): c or u
  modified_base (148)..(148): c or u
  modified_base (151)..(151): c or u
  modified_base (154)..(154): c or u
  modified_base (160)..(160): c or u
  modified_base (165)..(165): c or u
  modified_base (167)..(167): c or u
  modified_base (175)..(175): c or u
  modified_base (177)..(177): c or u
  modified_base (204)..(204): c or u
  modified_base (207)..(207): c or u
  modified_base (216)..(216): c or u
  modified_base (280)..(280): c or u
  modified_base (282)..(282): c or u
  modified_base (289)..(289): c or u
  modified_base (294)..(294): c or u
nggagtggagutttgggaauuuutngguuaaguauagnggttngaaaatauagutgaaauuuagnggguuuttaguangnguuuuagngunggaguagggtuagggtuttuttgngauunggutungutuuagatuuuuuuagututnggnggnggauungggungngtgtgagngngutttguauutuutatuuuuagggtungungagaguuangattttttauagaaaatgaguaataaagagattttgtautgtuutgautggggagtuuuaggungnggggganggagnguuuut

SEQ ID NO: 58 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (11)..(11): c or u
  modified_base (18)..(18): c or u
  modified_base (20)..(20): c or u
  modified_base (84)..(84): c or u
  modified_base (93)..(93): c or u
  modified_base (96)..(96): c or u
  modified_base (123)..(123): c or u
  modified_base (125)..(125): c or u
  modified_base (133)..(133): c or u
  modified_base (135)..(135): c or u
  modified_base (140)..(140): c or u
  modified_base (146)..(146): c or u
  modified_base (149)..(149): c or u
  modified_base (152)..(152): c or u
  modified_base (174)..(174): c or u
  modified_base (180)..(180): c or u
  modified_base (185)..(185): c or u
  modified_base (209)..(209): c or u
  modified_base (212)..(212): c or u
  modified_base (220)..(220): c or u
  modified_base (222)..(222): c or u
  modified_base (235)..(235): c or u
  modified_base (257)..(257): c or u
  modified_base (262)..(262): c or u
  modified_base (275)..(275): c or u
  modified_base (299)..(299): c or u
aggggngutungtuuuungngguutgggautuuuuagtuaggauagtauaaaatututttattgutuattttutgtaaaaaatngtggututnggnggauuutggggataggaggtguaaagngngutuauangngguungggtungungungagagutggggggatutggagnggagungggtnguaagaagauuutgauuutgutunggngutggggngngtgutaaggguungutgggtttuagutgtattttngaaungutgtguttggungaggggttuuuaaagutuuautung

SEQ ID NO: 59 - DNA, 300 bp, Artificial Sequence
  Description of Artificial Sequence: Synthetic oligonucleotide
  Description of Combined DNA/RNA Molecule: Synthetic oligonucleotide
  modified_base (57)..(57): c or u
  modified_base (62)..(62): c or u
  modified_base (65)..(65): c or u
  modified_base (84)..(84): c or u
  modified_base (111)..(111): c or u
  modified_base (123)..(123): c or u
  modified_base (128)..(128): c or u
  modified_base (142)..(142): c or u
  modified_base (144)..(144): c or u
  modified_base (147)..(147): c or u
  modified_base (150)..(150): c or u
  modified_base (203)..(203): c or u
  modified_base (238)..(238): c or u
  modified_base (255)..(255): c or u
  modified_base (264)..(264): c or u
  modified_base (269)..(269): c or u
  modified_base (281)..(281): c or u
  modified_base (290)..(290): c or u
  modified_base (293)..(293): c or u
  modified_base (297)..(297): c or u
aaaaatauuutagattuataaauaaaaguttguagttauuuauaguuuaatauaaangauunganguuutuauttutataguungtgagtutuuuaguuuutaauaggutngtutuuuuaganguuungggtgaaaaggttngngungunggtggagagtuutattggttutatttutgtuttuautuuaagguuuuaggaunggggagaggtuutggtutaautttggutgtuuuanggtuuaaggauutuagngutuaguungaaangutaaguuaagngtggagaungungggngua

SEQ ID NO: 60 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (7)..(7): c or u
  modified_base (10)..(10): c or u
  modified_base (19)..(19): c or u
  modified_base (31)..(31): c or u
  modified_base (36)..(36): c or u
  modified_base (45)..(45): c or u
  modified_base (62)..(62): c or u
  modified_base (97)..(97): c or u
  modified_base (150)..(150): c or u
  modified_base (153)..(153): c or u
  modified_base (156)..(156): c or u
  modified_base (158)..(158): c or u
  modified_base (172)..(172): c or u
  modified_base (177)..(177): c or u
  modified_base (189)..(189): c or u
  modified_base (216)..(216): c or u
  modified_base (235)..(235): c or u
  modified_base (238)..(238): c or u
  modified_base (243)..(243): c or u
tgnguunggnggtutuuanguttgguttagngtttngggutgagngutgaggtuuttggaungtgggauaguuaaagttagauuaggauututuuunggtuutgggguuttggagtgaagauagaaatagaauuaataggaututuuaunggnggngngaauuttttuauunggggngtutggggagangaguutgttaggggutgggagautuangggutatagaagtgagggngtngggtngtttgtattgggutgtgggtaautguaaguttttgtttatgaatutagggtattttt

SEQ ID NO: 61 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (31)..(31): c or u
  modified_base (33)..(33): c or u
  modified_base (45)..(45): c or u
  modified_base (58)..(58): c or u
  modified_base (65)..(65): c or u
  modified_base (82)..(82): c or u
  modified_base (100)..(100): c or u
  modified_base (131)..(131): c or u
  modified_base (144)..(144): c or u
  modified_base (150)..(150): c or u
  modified_base (156)..(156): c or u
  modified_base (174)..(174): c or u
  modified_base (200)..(200): c or u
  modified_base (205)..(205): c or u
  modified_base (214)..(214): c or u
  modified_base (235)..(235): c or u
  modified_base (249)..(249): c or u
  modified_base (253)..(253): c or u
  modified_base (261)..(261): c or u
  modified_base (266)..(266): c or u
  modified_base (272)..(272): c or u
  modified_base (281)..(281): c or u
  modified_base (299)..(299): c or u
aguuangauututguuuutatggggtuuagngnguauttgggtgngggtgatuuutunggaagtngututgutuututggungggtutuutuututtuungguuauttatauuuttgaguauuaagagttnguuuatttaggunguutungggaanggaagggtuuauuuuaunguuaggututuaaagggtggggtggnguutngggtggggnggguaggaggtgggtgaggangggagagaaggggngagnggggguanggggnggggunggutuagtnggggtagatgatgaagung

SEQ ID NO: 62 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (19)..(19): c or u
  modified_base (28)..(28): c or u
  modified_base (34)..(34): c or u
  modified_base (39)..(39): c or u
  modified_base (47)..(47): c or u
  modified_base (51)..(51): c or u
  modified_base (65)..(65): c or u
  modified_base (86)..(86): c or u
  modified_base (95)..(95): c or u
  modified_base (100)..(100): c or u
  modified_base (126)..(126): c or u
  modified_base (144)..(144): c or u
  modified_base (150)..(150): c or u
  modified_base (156)..(156): c or u
  modified_base (169)..(169): c or u
  modified_base (200)..(200): c or u
  modified_base (218)..(218): c or u
  modified_base (235)..(235): c or u
  modified_base (242)..(242): c or u
  modified_base (255)..(255): c or u
  modified_base (267)..(267): c or u
  modified_base (269)..(269): c or u
  modified_base (294)..(294): c or u
ngguttuatuatutauuungautgagungguuunguuungtguuuungutnguuuuttututuungtuutuauuuauutuutguunguuuuauungaggnguuauuuuauuutttgagaguutggnggtggggtggauuuttungttuunggaggngguutaaatgggngaaututtggtgutuaagggtataagtggungggaagaggaggagauungguuagaggaguagagngauttunggagggatuauunguauuuaagtgngngutggauuuuatagggguagaggtngtggut

SEQ ID NO: 63 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (14)..(14): c or u
  modified_base (27)..(27): c or u
  modified_base (43)..(43): c or u
  modified_base (45)..(45): c or u
  modified_base (73)..(73): c or u
  modified_base (82)..(82): c or u
  modified_base (87)..(87): c or u
  modified_base (90)..(90): c or u
  modified_base (92)..(92): c or u
  modified_base (100)..(100): c or u
  modified_base (103)..(103): c or u
  modified_base (105)..(105): c or u
  modified_base (122)..(122): c or u
  modified_base (141)..(141): c or u
  modified_base (148)..(148): c or u
  modified_base (153)..(153): c or u
  modified_base (159)..(159): c or u
  modified_base (161)..(161): c or u
  modified_base (167)..(167): c or u
  modified_base (177)..(177): c or u
  modified_base (180)..(180): c or u
  modified_base (183)..(183): c or u
  modified_base (188)..(188): c or u
  modified_base (198)..(198): c or u
  modified_base (201)..(201): c or u
  modified_base (217)..(217): c or u
  modified_base (227)..(227): c or u
  modified_base (230)..(230): c or u
  modified_base (247)..(247): c or u
  modified_base (263)..(263): c or u
  modified_base (265)..(265): c or u
  modified_base (270)..(270): c or u
  modified_base (294)..(294): c or u
  modified_base (296)..(296): c or u
unguttgggtaaunguaguutguutgngtututtuuttuutungngtgggttutaguaauatuuautguagunggguuaggngagunggngngtauuatnggngnggggggaggagagggunggguutgggaagatgutgnggaggangutgnggattngngaguunggggtaaggnggnggnguaunguuuuutuungunguttuuuuuuuauuunguuuuuuaungunguuuttaguuutuuuungggatgagagagagtngngutgnggaguaauuuuagtggatgggtungngggg

SEQ ID NO: 64 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (6)..(6): c or u
  modified_base (30)..(30): c or u
  modified_base (35)..(35): c or u
  modified_base (37)..(37): c or u
  modified_base (53)..(53): c or u
  modified_base (70)..(70): c or u
  modified_base (73)..(73): c or u
  modified_base (83)..(83): c or u
  modified_base (99)..(99): c or u
  modified_base (102)..(102): c or u
  modified_base (112)..(112): c or u
  modified_base (117)..(117): c or u
  modified_base (120)..(120): c or u
  modified_base (123)..(123): c or u
  modified_base (133)..(133): c or u
  modified_base (139)..(139): c or u
  modified_base (141)..(141): c or u
  modified_base (147)..(147): c or u
  modified_base (152)..(152): c or u
  modified_base (159)..(159): c or u
  modified_base (178)..(178): c or u
  modified_base (195)..(195): c or u
  modified_base (197)..(197): c or u
  modified_base (200)..(200): c or u
  modified_base (208)..(208): c or u
  modified_base (210)..(210): c or u
  modified_base (213)..(213): c or u
  modified_base (218)..(218): c or u
  modified_base (227)..(227): c or u
  modified_base (255)..(255): c or u
  modified_base (257)..(257): c or u
  modified_base (273)..(273): c or u
  modified_base (286)..(286): c or u
  modified_base (298)..(298): c or u
uuungnggauuuatuuautggggttgutunguagngngaututututuatuungggggagggutaagggnggnggtggggggnggggtgggggggaagnggngggagggggnggtgngungunguuttauuungggutngngaatunguagngtuutunguaguatuttuuuagguungguuututuutuuuuungngungatggtangngunggutnguutgguunggutguagtggatgttgutagaauuuangnggaggaaggaagaganguagguaggutgnggttauuuaagngg

SEQ ID NO: 65 - DNA, 300 bp, Artificial Sequence
  Description of Artificial Sequence: Synthetic oligonucleotide
  Description of Combined DNA/RNA Molecule: Synthetic oligonucleotide
  modified_base (26)..(26): c or u
  modified_base (47)..(47): c or u
  modified_base (50)..(50): c or u
  modified_base (60)..(60): c or u
  modified_base (68)..(68): c or u
  modified_base (70)..(70): c or u
  modified_base (75)..(75): c or u
  modified_base (78)..(78): c or u
  modified_base (86)..(86): c or u
  modified_base (89)..(89): c or u
  modified_base (97)..(97): c or u
  modified_base (107)..(107): c or u
  modified_base (150)..(150): c or u
  modified_base (173)..(173): c or u
  modified_base (177)..(177): c or u
  modified_base (186)..(186): c or u
  modified_base (197)..(197): c or u
  modified_base (236)..(236): c or u
atutuuuuttutguutgtgatatggngggutguattauaagutgggngtngagataaagnggggagungnggganggngguuuagngungggguuungggtggggungguuagggagataaggguutuuuaguuuuatgaattattuaungguautguutuututggutgggnggunguuutgggngutgagattgngtuttuuagagggguutgggtagggtgggaggggggtungtggggaaggguaguaggutgtagaggggtuttuutatgggggatggggagaggggaggautgt

SEQ ID NO: 66 - DNA, 300 bp, Artificial Sequence
  Description of Artificial Sequence: Synthetic oligonucleotide
  Description of Combined DNA/RNA Molecule: Synthetic oligonucleotide
  modified_base (64)..(64): c or u
  modified_base (103)..(103): c or u
  modified_base (114)..(114): c or u
  modified_base (123)..(123): c or u
  modified_base (127)..(127): c or u
  modified_base (150)..(150): c or u
  modified_base (193)..(193): c or u
  modified_base (203)..(203): c or u
  modified_base (211)..(211): c or u
  modified_base (214)..(214): c or u
  modified_base (222)..(222): c or u
  modified_base (225)..(225): c or u
  modified_base (230)..(230): c or u
  modified_base (232)..(232): c or u
  modified_base (240)..(240): c or u
  modified_base (250)..(250): c or u
  modified_base (253)..(253): c or u
  modified_base (274)..(274): c or u
auagtuutuuuututuuuuatuuuuuataggaagauuuututauaguutgutguuuttuuuuanggauuuuuutuuuauuutauuuagguuuututggaaganguaatutuagnguuuagggnggunguuuaguuagaggagguagtgunggtgaataattuatggggutgggagguuuttatutuuutggungguuuuauungggguuunggngutgggungungtuungnggutuuungutttatutnganguuuaguttgtaatguaguunguuatatuauagguagaaggggagat

SEQ ID NO: 67 - DNA, 300 bp, Artificial Sequence
  Description of Artificial Sequence: Synthetic oligonucleotide
  Description of Combined DNA/RNA Molecule: Synthetic oligonucleotide
  modified_base (25)..(25): c or u
  modified_base (28)..(28): c or u
  modified_base (34)..(34): c or u
  modified_base (37)..(37): c or u
  modified_base (64)..(64): c or u
  modified_base (71)..(71): c or u
  modified_base (76)..(76): c or u
  modified_base (82)..(82): c or u
  modified_base (88)..(88): c or u
  modified_base (106)..(106): c or u
  modified_base (111)..(111): c or u
  modified_base (133)..(133): c or u
  modified_base (139)..(139): c or u
  modified_base (143)..(143): c or u
  modified_base (150)..(150): c or u
  modified_base (154)..(154): c or u
  modified_base (166)..(166): c or u
  modified_base (168)..(168): c or u
  modified_base (172)..(172): c or u
  modified_base (178)..(178): c or u
  modified_base (187)..(187): c or u
  modified_base (199)..(199): c or u
  modified_base (202)..(202): c or u
  modified_base (204)..(204): c or u
  modified_base (221)..(221): c or u
  modified_base (223)..(223): c or u
  modified_base (226)..(226): c or u
  modified_base (232)..(232): c or u
  modified_base (241)..(241): c or u
  modified_base (250)..(250): c or u
  modified_base (260)..(260): c or u
  modified_base (266)..(266): c or u
  modified_base (272)..(272): c or u
  modified_base (275)..(275): c or u
  modified_base (278)..(278): c or u
  modified_base (281)..(281): c or u
  modified_base (293)..(293): c or u
  modified_base (296)..(296): c or u
  modified_base (299)..(299): c or u
aggtuatuuaguaguagggutuuangtnggtutngtngatguuuuagaagguuagutuutuutngaagagngguunguauangtutgngggguagtguaguttgunggtgnggtagtaattgaguauataggngaaganguungggtgunggtngaagaagaautngnggunguuaungggatggtngutgguuutgungungngggaautguagttguungngunguuutngaaguagunguutgguungggggauagngggggngututnggnggnggngauagtggaggnggngang

SEQ ID NO: 68 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (4)..(4): c or u
  modified_base (7)..(7): c or u
  modified_base (19)..(19): c or u
  modified_base (22)..(22): c or u
  modified_base (25)..(25): c or u
  modified_base (28)..(28): c or u
  modified_base (34)..(34): c or u
  modified_base (40)..(40): c or u
  modified_base (50)..(50): c or u
  modified_base (59)..(59): c or u
  modified_base (68)..(68): c or u
  modified_base (74)..(74): c or u
  modified_base (77)..(77): c or u
  modified_base (79)..(79): c or u
  modified_base (96)..(96): c or u
  modified_base (98)..(98): c or u
  modified_base (101)..(101): c or u
  modified_base (113)..(113): c or u
  modified_base (122)..(122): c or u
  modified_base (128)..(128): c or u
  modified_base (132)..(132): c or u
  modified_base (134)..(134): c or u
  modified_base (146)..(146): c or u
  modified_base (150)..(150): c or u
  modified_base (157)..(157): c or u
  modified_base (161)..(161): c or u
  modified_base (167)..(167): c or u
  modified_base (189)..(189): c or u
  modified_base (194)..(194): c or u
  modified_base (212)..(212): c or u
  modified_base (218)..(218): c or u
  modified_base (224)..(224): c or u
  modified_base (229)..(229): c or u
  modified_base (236)..(236): c or u
  modified_base (263)..(263): c or u
  modified_base (266)..(266): c or u
  modified_base (272)..(272): c or u
  modified_base (275)..(275): c or u
ngtngunguutuuautgtngungungungagagnguuuungutgtuuuunggguuaggnggutguttngagggnggngnggguaautguagttuungnggngguaggguuagngauuatuunggtggnggungngagttuttuttngaungguauungggngtuttnguutatgtgutuaattautaunguaungguaagutguautguuunguagangtgtgngggungututtngaggaggagutgguuttutgggguatngangagaungangtggaguuutgutgutggatgauut

SEQ ID NO: 69 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (21)..(21): c or u
  modified_base (23)..(23): c or u
  modified_base (84)..(84): c or u
  modified_base (94)..(94): c or u
  modified_base (132)..(132): c or u
  modified_base (145)..(145): c or u
  modified_base (151)..(151): c or u
  modified_base (153)..(153): c or u
  modified_base (160)..(160): c or u
  modified_base (164)..(164): c or u
  modified_base (178)..(178): c or u
  modified_base (187)..(187): c or u
  modified_base (190)..(190): c or u
  modified_base (197)..(197): c or u
  modified_base (213)..(213): c or u
  modified_base (226)..(226): c or u
  modified_base (234)..(234): c or u
  modified_base (244)..(244): c or u
  modified_base (252)..(252): c or u
  modified_base (264)..(264): c or u
  modified_base (266)..(266): c or u
  modified_base (274)..(274): c or u
  modified_base (292)..(292): c or u
ngtattaauaggttuuuutungnguauautgauatatttuttatuuuuuataatgaattuaguuatatgguattutttuuuatngaagguuatngggaatggutttaggaagutgattttuaagutttaagngguaguaggtgungguagngnggggaungatngatggagagaaggnggguaagangungggaagnguattuutuutuaaungagtguuauaaunguuutuungaagtguuungggguttngaguatuauutngnggtaatungggagggtggagggatgnggutggau

SEQ ID NO: 70 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (26)..(26): c or u
  modified_base (34)..(34): c or u
  modified_base (36)..(36): c or u
  modified_base (48)..(48): c or u
  modified_base (56)..(56): c or u
  modified_base (66)..(66): c or u
  modified_base (74)..(74): c or u
  modified_base (87)..(87): c or u
  modified_base (103)..(103): c or u
  modified_base (110)..(110): c or u
  modified_base (113)..(113): c or u
  modified_base (122)..(122): c or u
  modified_base (136)..(136): c or u
  modified_base (140)..(140): c or u
  modified_base (147)..(147): c or u
  modified_base (149)..(149): c or u
  modified_base (155)..(155): c or u
  modified_base (168)..(168): c or u
  modified_base (206)..(206): c or u
  modified_base (216)..(216): c or u
  modified_base (277)..(277): c or u
  modified_base (279)..(279): c or u
  modified_base (299)..(299): c or u
gtuuagunguatuuutuuauuutuunggattaungngaggtgatgutngaaguuungggguauttngggagggnggttgtgguautnggttgaggaggaatgnguttuunggngtuttguunguuttututuuatngatnggtuuungngutgungguauutgutgunguttaaaguttgaaaatuaguttuutaaaguuattuungatgguuttngatgggaaagaatguuatatggutgaattuattatgggggataagaaatatgtuagtgtgngnggaggggaauutgttaatang

SEQ ID NO: 71 - DNA, 300 bp, Artificial Sequence
  Description of Artificial Sequence: Synthetic oligonucleotide
  Description of Combined DNA/RNA Molecule: Synthetic oligonucleotide
  modified_base (39)..(39): c or u
  modified_base (101)..(101): c or u
  modified_base (150)..(150): c or u
  modified_base (205)..(205): c or u
  modified_base (215)..(215): c or u
gtututgutatuuagguutatgagaatuaaguttttaungttuuutttgggguutggatagttttuaagutguuttutuutuauatuatgtgagtagagungguuaagaaaauuagggagauatutuuuuuuaguutgguuuagauttunggguuuuauuuuaggagagaguutuuuaututgguuagtguuutguaaaguuttnguuuuauuunguuuuaatttutuuttatguutggutuattuuttaggggutgagttgggagataagauttggggttguagttgutggggatuatt

SEQ ID NO: 72 - DNA, 300 bp, Artificial Sequence
  Description of Artificial Sequence: Synthetic oligonucleotide
  Description of Combined DNA/RNA Molecule: Synthetic oligonucleotide
  modified_base (85)..(85): c or u
  modified_base (95)..(95): c or u
  modified_base (150)..(150): c or u
  modified_base (199)..(199): c or u
  modified_base (261)..(261): c or u
aatgatuuuuaguaautguaauuuuaagtuttatutuuuaautuaguuuutaaggaatgaguuagguataaggagaaattggggnggggtggggngaaggutttguaggguautgguuagagtgggaggutututuutggggtgggguunggaagtutggguuaggutggggggagatgtutuuutggttttuttggunggututautuauatgatgtgaggagaagguaguttgaaaautatuuagguuuuaaagggaanggtaaaaguttgattutuatagguutggataguagagau

SEQ ID NO: 73 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (5)..(5): c or u
  modified_base (14)..(14): c or u
  modified_base (26)..(26): c or u
  modified_base (33)..(33): c or u
  modified_base (40)..(40): c or u
  modified_base (46)..(46): c or u
  modified_base (48)..(48): c or u
  modified_base (55)..(55): c or u
  modified_base (61)..(61): c or u
  modified_base (63)..(63): c or u
  modified_base (68)..(68): c or u
  modified_base (91)..(91): c or u
  modified_base (93)..(93): c or u
  modified_base (96)..(96): c or u
  modified_base (102)..(102): c or u
  modified_base (107)..(107): c or u
  modified_base (112)..(112): c or u
  modified_base (114)..(114): c or u
  modified_base (116)..(116): c or u
  modified_base (124)..(124): c or u
  modified_base (133)..(133): c or u
  modified_base (139)..(139): c or u
  modified_base (146)..(146): c or u
  modified_base (150)..(150): c or u
  modified_base (152)..(152): c or u
  modified_base (154)..(154): c or u
  modified_base (161)..(161): c or u
  modified_base (173)..(173): c or u
  modified_base (178)..(178): c or u
  modified_base (180)..(180): c or u
  modified_base (182)..(182): c or u
  modified_base (190)..(190): c or u
  modified_base (198)..(198): c or u
  modified_base (202)..(202): c or u
  modified_base (206)..(206): c or u
  modified_base (209)..(209): c or u
  modified_base (220)..(220): c or u
  modified_base (222)..(222): c or u
  modified_base (229)..(229): c or u
  modified_base (257)..(257): c or u
  modified_base (267)..(267): c or u
  modified_base (279)..(279): c or u
  modified_base (290)..(290): c or u
gngungggguutangaaguutgggungggggunggggggnggggangngggauunggggangnggggngutuaguuagguuuuutuuagungngunggggungtuungagungngnguauaaanggatgggunggtgunguutgungggngngngggggtnggtguuttutgngtggngngngtgtuuungggtutungtgnggunggnguattgguutngngututunggaggggautgaguaggtgaauagguunggaguutgtngtggagggguungggaagguutngutguagaag

SEQ ID NO: 74 - DNA, 300 bp, Artificial Sequence
  Description of Artificial Sequence: Synthetic oligonucleotide
  Description of Combined DNA/RNA Molecule: Synthetic oligonucleotide
  modified_base (10)..(10): c or u
  modified_base (21)..(21): c or u
  modified_base (33)..(33): c or u
  modified_base (43)..(43): c or u
  modified_base (71)..(71): c or u
  modified_base (78)..(78): c or u
  modified_base (80)..(80): c or u
  modified_base (91)..(91): c or u
  modified_base (94)..(94): c or u
  modified_base (98)..(98): c or u
  modified_base (102)..(102): c or u
  modified_base (110)..(110): c or u
  modified_base (118)..(118): c or u
  modified_base (120)..(120): c or u
  modified_base (122)..(122): c or u
  modified_base (127)..(127): c or u
  modified_base (139)..(139): c or u
  modified_base (146)..(146): c or u
  modified_base (148)..(148): c or u
  modified_base (150)..(150): c or u
  modified_base (154)..(154): c or u
  modified_base (161)..(161): c or u
  modified_base (167)..(167): c or u
  modified_base (176)..(176): c or u
  modified_base (184)..(184): c or u
  modified_base (186)..(186): c or u
  modified_base (188)..(188): c or u
  modified_base (193)..(193): c or u
  modified_base (198)..(198): c or u
  modified_base (204)..(204): c or u
  modified_base (207)..(207): c or u
  modified_base (209)..(209): c or u
  modified_base (232)..(232): c or u
  modified_base (237)..(237): c or u
  modified_base (239)..(239): c or u
  modified_base (245)..(245): c or u
  modified_base (252)..(252): c or u
  modified_base (254)..(254): c or u
  modified_base (260)..(260): c or u
  modified_base (267)..(267): c or u
  modified_base (274)..(274): c or u
  modified_base (286)..(286): c or u
  modified_base (295)..(295): c or u
  modified_base (298)..(298): c or u
uttutguagngagguuttuunggguuuutuuangauaggutunggguutgttuauutgutuagtuuuutunggagagngngagguuaatgngunggunguanggagauunggggauangngnguuanguagaagguaungauuuungngnguungguaggngguaungguuuatungtttgtgngngnggutngggangguuunggngnggutggaggggguutggutgagnguuungngtuuungggtuungngtuuunguuuuungguuuungguuuagguttngtagguuunggngu

SEQ ID NO: 75 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (17)..(17): c or u
  modified_base (23)..(23): c or u
  modified_base (30)..(30): c or u
  modified_base (34)..(34): c or u
  modified_base (36)..(36): c or u
  modified_base (38)..(38): c or u
  modified_base (45)..(45): c or u
  modified_base (57)..(57): c or u
  modified_base (62)..(62): c or u
  modified_base (64)..(64): c or u
  modified_base (66)..(66): c or u
  modified_base (74)..(74): c or u
  modified_base (82)..(82): c or u
  modified_base (86)..(86): c or u
  modified_base (90)..(90): c or u
  modified_base (93)..(93): c or u
  modified_base (104)..(104): c or u
  modified_base (106)..(106): c or u
  modified_base (113)..(113): c or u
  modified_base (141)..(141): c or u
  modified_base (151)..(151): c or u
  modified_base (163)..(163): c or u
  modified_base (174)..(174): c or u
  modified_base (203)..(203): c or u
  modified_base (213)..(213): c or u
  modified_base (218)..(218): c or u
  modified_base (225)..(225): c or u
  modified_base (227)..(227): c or u
  modified_base (236)..(236): c or u
  modified_base (239)..(239): c or u
  modified_base (245)..(245): c or u
  modified_base (247)..(247): c or u
  modified_base (258)..(258): c or u
  modified_base (265)..(265): c or u
  modified_base (267)..(267): c or u
  modified_base (285)..(285): c or u
  modified_base (287)..(287): c or u
  modified_base (292)..(292): c or u
  modified_base (299)..(299): c or u
guauaaanggatgggunggtgunguutgungggngngngggggtnggtguuttutgngtggngngngtgtuuungggtutungtgnggunggnguattgguutngngututunggaggggautgaguaggtgaauagguunggaguutgtngtggagggguungggaagguutngutguagaaguaggatgggaguaggatunguagggatgnguagnggggtungnggagutuunggngggggngngtttuuaggunggggaungnggtguuaguuutguuutngnggatngggtutng

SEQ ID NO: 76 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (8)..(8): c or u
  modified_base (13)..(13): c or u
  modified_base (15)..(15): c or u
  modified_base (33)..(33): c or u
  modified_base (35)..(35): c or u
  modified_base (42)..(42): c or u
  modified_base (53)..(53): c or u
  modified_base (55)..(55): c or u
  modified_base (61)..(61): c or u
  modified_base (64)..(64): c or u
  modified_base (73)..(73): c or u
  modified_base (75)..(75): c or u
  modified_base (82)..(82): c or u
  modified_base (87)..(87): c or u
  modified_base (97)..(97): c or u
  modified_base (126)..(126): c or u
  modified_base (137)..(137): c or u
  modified_base (149)..(149): c or u
  modified_base (159)..(159): c or u
  modified_base (187)..(187): c or u
  modified_base (194)..(194): c or u
  modified_base (196)..(196): c or u
  modified_base (207)..(207): c or u
  modified_base (210)..(210): c or u
  modified_base (214)..(214): c or u
  modified_base (218)..(218): c or u
  modified_base (226)..(226): c or u
  modified_base (234)..(234): c or u
  modified_base (236)..(236): c or u
  modified_base (238)..(238): c or u
  modified_base (243)..(243): c or u
  modified_base (255)..(255): c or u
  modified_base (262)..(262): c or u
  modified_base (264)..(264): c or u
  modified_base (266)..(266): c or u
  modified_base (270)..(270): c or u
  modified_base (277)..(277): c or u
  modified_base (283)..(283): c or u
  modified_base (292)..(292): c or u
ngagauungatungngaggguagggutgguaungnggtuuungguutggaaangnguuuungungggagutungnggauuungutgnguatuuutgnggatuutgutuuuatuutguttutguagngagguuttuunggguuuutuuangauaggutunggguutgttuauutgutuagtuuuutunggagagngngagguuaatgngunggunguanggagauunggggauangngnguuanguagaagguaungauuuungngnguungguaggngguaungguuuatungtttgtgu

SEQ ID NO: 77 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (12)..(12): c or u
  modified_base (18)..(18): c or u
  modified_base (20)..(20): c or u
  modified_base (30)..(30): c or u
  modified_base (38)..(38): c or u
  modified_base (49)..(49): c or u
  modified_base (69)..(69): c or u
  modified_base (113)..(113): c or u
  modified_base (121)..(121): c or u
  modified_base (137)..(137): c or u
  modified_base (139)..(139): c or u
  modified_base (151)..(151): c or u
  modified_base (158)..(158): c or u
  modified_base (165)..(165): c or u
  modified_base (167)..(167): c or u
  modified_base (170)..(170): c or u
  modified_base (205)..(205): c or u
  modified_base (269)..(269): c or u
uttnggguagungagggngngggatgautnggguaggngtgtgguutungautgauuagggttggguungggatuagagutttguttggaagttututgggtgguagagautnggguaaunggaguutgaguutuungnggggaagagutnggautunggaggtngngunguuttggguttgaattuagtuuttuuttautautngtggutttguttauatuatttaaututuuatttuuttgtutatauagtgggutuataaggaggnggtaaggagatgatgatgtutttgaagagtt

SEQ ID NO: 78 - DNA, 300 bp, Artificial Sequence
  Description of Artificial Sequence: Synthetic oligonucleotide
  Description of Combined DNA/RNA Molecule: Synthetic oligonucleotide
  modified_base (31)..(31): c or u
  modified_base (95)..(95): c or u
  modified_base (130)..(130): c or u
  modified_base (133)..(133): c or u
  modified_base (135)..(135): c or u
  modified_base (142)..(142): c or u
  modified_base (149)..(149): c or u
  modified_base (161)..(161): c or u
  modified_base (163)..(163): c or u
  modified_base (179)..(179): c or u
  modified_base (187)..(187): c or u
  modified_base (231)..(231): c or u
  modified_base (251)..(251): c or u
  modified_base (262)..(262): c or u
  modified_base (270)..(270): c or u
  modified_base (280)..(280): c or u
  modified_base (282)..(282): c or u
  modified_base (288)..(288): c or u
  modified_base (296)..(296): c or u
aaututtuaaagauatuatuatutuuttaunguutuuttatgaguuuautgtatagauaaggaaatggagagttaaatgatgtaaguaaaguuangagtagtaaggaaggautgaattuaaguuuaaggnggngngauutunggagtungagututtuuungngggaggutuaggutunggttguungagtututguuauuuagagaauttuuaaguaaagututgatuunggguuuaauuutggtuagtnggagguuauanguutguungagtuatuungnguuutnggutguungaag

SEQ ID NO: 79 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (15)..(15): c or u
  modified_base (34)..(34): c or u
  modified_base (48)..(48): c or u
  modified_base (81)..(81): c or u
  modified_base (97)..(97): c or u
  modified_base (108)..(108): c or u
  modified_base (113)..(113): c or u
  modified_base (141)..(141): c or u
  modified_base (150)..(150): c or u
  modified_base (166)..(166): c or u
  modified_base (185)..(185): c or u
  modified_base (208)..(208): c or u
  modified_base (214)..(214): c or u
  modified_base (229)..(229): c or u
  modified_base (237)..(237): c or u
  modified_base (254)..(254): c or u
  modified_base (295)..(295): c or u
unguaguuautautnguuuuauuttutuauutungaggggttgaauungagttgtutgttggggtttagggautuaggatngggtutgagggauttngauataagtgngtggnggtagtgggtatauaggggaggggggunggguuuutngutuuttutggaaaunggguuuuauttguagguungguuauuttgggttutggtggungaagunggagutgtgtttutnguagautnggggagutauattgtgngtagguaattgtttagtttgaaaggagguauatttuauuanguagu

SEQ ID NO: 80 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (46)..(46): c or u
  modified_base (63)..(63): c or u
  modified_base (71)..(71): c or u
  modified_base (86)..(86): c or u
  modified_base (92)..(92): c or u
  modified_base (115)..(115): c or u
  modified_base (134)..(134): c or u
  modified_base (150)..(150): c or u
  modified_base (159)..(159): c or u
  modified_base (187)..(187): c or u
  modified_base (192)..(192): c or u
  modified_base (203)..(203): c or u
  modified_base (219)..(219): c or u
  modified_base (252)..(252): c or u
  modified_base (266)..(266): c or u
  modified_base (285)..(285): c or u
  modified_base (298)..(298): c or u
gutgngtggtgaaatgtguutuutttuaaautaaauaattguutanguauaatgtagutuuungagtutgngagaaauauagutungguttngguuauuagaauuuaaggtggunggguutguaagtgggguunggtttuuagaaggagngagggguungguuuuuutuuuutgtatauuuautaunguuanguauttatgtngaagtuuutuagauungatuutgagtuuutaaauuuuaauagauaautngggttuaauuuutnggaggtgagaaggtggggngagtagtggutgngg

SEQ ID NO: 81 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (27)..(27): c or u
  modified_base (32)..(32): c or u
  modified_base (40)..(40): c or u
  modified_base (53)..(53): c or u
  modified_base (120)..(120): c or u
  modified_base (150)..(150): c or u
  modified_base (157)..(157): c or u
  modified_base (159)..(159): c or u
  modified_base (163)..(163): c or u
  modified_base (168)..(168): c or u
  modified_base (177)..(177): c or u
  modified_base (183)..(183): c or u
  modified_base (188)..(188): c or u
  modified_base (193)..(193): c or u
  modified_base (197)..(197): c or u
  modified_base (206)..(206): c or u
  modified_base (210)..(210): c or u
  modified_base (224)..(224): c or u
  modified_base (244)..(244): c or u
  modified_base (246)..(246): c or u
  modified_base (253)..(253): c or u
  modified_base (270)..(270): c or u
  modified_base (289)..(289): c or u
  modified_base (292)..(292): c or u
utuuutgnggutuuautagttttuttnguuunguuuagunguuuaututtutnggutagggaagaagauuagagggtgutuagutggaaaaututggtgtutuaguttaggguutuutungggaagagutaautgutuuuaggtgaagunggtguungngggnggtungtauauuunguagunggutnguaungutngagaguutnggungutgtgtuttuuangtutguagutuaguuagggngnguagggngagtggggtuuautggngggtaaaggggauuagganggngaggatgg

SEQ ID NO: 82 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (11)..(11): c or u
  modified_base (30)..(30): c or u
  modified_base (47)..(47): c or u
  modified_base (54)..(54): c or u
  modified_base (56)..(56): c or u
  modified_base (76)..(76): c or u
  modified_base (90)..(90): c or u
  modified_base (94)..(94): c or u
  modified_base (103)..(103): c or u
  modified_base (107)..(107): c or u
  modified_base (112)..(112): c or u
  modified_base (117)..(117): c or u
  modified_base (123)..(123): c or u
  modified_base (132)..(132): c or u
  modified_base (137)..(137): c or u
  modified_base (141)..(141): c or u
  modified_base (143)..(143): c or u
  modified_base (150)..(150): c or u
  modified_base (180)..(180): c or u
  modified_base (247)..(247): c or u
  modified_base (260)..(260): c or u
  modified_base (268)..(268): c or u
  modified_base (273)..(273): c or u
  modified_base (292)..(292): c or u
uuatuutngungtuutggtuuuutttauunguuagtggauuuuautnguuutgngnguuutggutgagutguagangtggaagauauagnggungaggututngagnggtgngagunggutgnggggtgtanggaunguungnggguaungguttuauutgggaguagttagututtuunggaggagguuutaagutgagauauuagagttttuuagutgaguauuututggtuttuttuuutagungagaagagtgggnggutgggnggggngaagaaaautagtggagunguagggag

SEQ ID NO: 83 - DNA, 300 bp, Artificial Sequence
  Description of Artificial Sequence: Synthetic oligonucleotide
  Description of Combined DNA/RNA Molecule: Synthetic oligonucleotide
  modified_base (13)..(13): c or u
  modified_base (24)..(24): c or u
  modified_base (31)..(31): c or u
  modified_base (33)..(33): c or u
  modified_base (38)..(38): c or u
  modified_base (44)..(44): c or u
  modified_base (46)..(46): c or u
  modified_base (57)..(57): c or u
  modified_base (59)..(59): c or u
  modified_base (65)..(65): c or u
  modified_base (72)..(72): c or u
  modified_base (74)..(74): c or u
  modified_base (108)..(108): c or u
  modified_base (125)..(125): c or u
  modified_base (129)..(129): c or u
  modified_base (132)..(132): c or u
  modified_base (143)..(143): c or u
  modified_base (156)..(156): c or u
  modified_base (158)..(158): c or u
  modified_base (171)..(171): c or u
  modified_base (186)..(186): c or u
  modified_base (195)..(195): c or u
  modified_base (207)..(207): c or u
  modified_base (213)..(213): c or u
  modified_base (224)..(224): c or u
  modified_base (227)..(227): c or u
  modified_base (230)..(230): c or u
  modified_base (233)..(233): c or u
  modified_base (237)..(237): c or u
  modified_base (240)..(240): c or u
  modified_base (249)..(249): c or u
  modified_base (252)..(252): c or u
  modified_base (255)..(255): c or u
  modified_base (258)..(258): c or u
  modified_base (260)..(260): c or u
  modified_base (263)..(263): c or u
  modified_base (272)..(272): c or u
  modified_base (276)..(276): c or u
  modified_base (278)..(278): c or u
  modified_base (282)..(282): c or u
  modified_base (284)..(284): c or u
  modified_base (288)..(288): c or u
tauatatgtauangtgtguauaunggtuutngngaggngguuungnggggtuatagngngguagngtaggungnggggtaggggtuuagutgggguttguuuatguungguaguaggatgtaggngagnggnggutguaguunggggutggguuangngutguagttguangggatuatgtaguungggttguungggutggggtgngagtgngtgtguuuuunggnggnggnggungungutguagungungungungngungtggaaggnguungnguungnggtngggtaguuuagu

SEQ ID NO: 84 - DNA, 300 bp, Artificial Sequence
  Description of Artificial Sequence: Synthetic oligonucleotide
  Description of Combined DNA/RNA Molecule: Synthetic oligonucleotide
  modified_base (12)..(12): c or u
  modified_base (16)..(16): c or u
  modified_base (18)..(18): c or u
  modified_base (22)..(22): c or u
  modified_base (24)..(24): c or u
  modified_base (28)..(28): c or u
  modified_base (37)..(37): c or u
  modified_base (40)..(40): c or u
  modified_base (42)..(42): c or u
  modified_base (45)..(45): c or u
  modified_base (48)..(48): c or u
  modified_base (51)..(51): c or u
  modified_base (60)..(60): c or u
  modified_base (63)..(63): c or u
  modified_base (67)..(67): c or u
  modified_base (70)..(70): c or u
  modified_base (73)..(73): c or u
  modified_base (76)..(76): c or u
  modified_base (87)..(87): c or u
  modified_base (93)..(93): c or u
  modified_base (105)..(105): c or u
  modified_base (114)..(114): c or u
  modified_base (129)..(129): c or u
  modified_base (142)..(142): c or u
  modified_base (144)..(144): c or u
  modified_base (157)..(157): c or u
  modified_base (168)..(168): c or u
  modified_base (171)..(171): c or u
  modified_base (175)..(175): c or u
  modified_base (192)..(192): c or u
  modified_base (226)..(226): c or u
  modified_base (228)..(228): c or u
  modified_base (235)..(235): c or u
  modified_base (241)..(241): c or u
  modified_base (243)..(243): c or u
  modified_base (254)..(254): c or u
  modified_base (256)..(256): c or u
  modified_base (262)..(262): c or u
  modified_base (267)..(267): c or u
  modified_base (269)..(269): c or u
  modified_base (276)..(276): c or u
  modified_base (287)..(287): c or u
gutgggutauungaungngggngngggnguuttuuanggngnggnggnggnggutguagnggnggungungungungggggguauanguautnguauuuuaguunggguaauungggutauatgatuungtguaautguagngngtgguuuaguuungggutguagungungutnguutauatuutgutgunggguatggguaaguuuuagutggauuuutauuungngguutangutgungngutatgauuungnggggunguutngngaggaunggtgtguauangtgtauatatgta

SEQ ID NO: 85 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (5)..(5): c or u
  modified_base (26)..(26): c or u
  modified_base (71)..(71): c or u
  modified_base (82)..(82): c or u
  modified_base (106)..(106): c or u
  modified_base (111)..(111): c or u
  modified_base (115)..(115): c or u
  modified_base (132)..(132): c or u
  modified_base (135)..(135): c or u
  modified_base (137)..(137): c or u
  modified_base (141)..(141): c or u
  modified_base (146)..(146): c or u
  modified_base (151)..(151): c or u
  modified_base (153)..(153): c or u
  modified_base (157)..(157): c or u
  modified_base (161)..(161): c or u
  modified_base (164)..(164): c or u
  modified_base (168)..(168): c or u
  modified_base (218)..(218): c or u
  modified_base (246)..(246): c or u
  modified_base (258)..(258): c or u
  modified_base (297)..(297): c or u
angunguuagututgattgguuuagnggtaggaaaggttaaauuaaaaatttttttauaguuutagtgtgnguutgtagutnggaaaattaattgtggutatagunguutngatngutgtutuuuuaguutngungnggungutungggangnguunguungunguunggututuuuuuuutttgggutgutgutgutgutgutgtgautgutgutgngagaggaggaggaggaggaggaaguagngggggggggagnggggggtggggggggagauuaagaagtauagttgggagngag

SEQ ID NO: 86 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (42)..(42): c or u
  modified_base (54)..(54): c or u
  modified_base (82)..(82): c or u
  modified_base (132)..(132): c or u
  modified_base (136)..(136): c or u
  modified_base (139)..(139): c or u
  modified_base (143)..(143): c or u
  modified_base (147)..(147): c or u
  modified_base (149)..(149): c or u
  modified_base (154)..(154): c or u
  modified_base (159)..(159): c or u
  modified_base (163)..(163): c or u
  modified_base (165)..(165): c or u
  modified_base (168)..(168): c or u
  modified_base (185)..(185): c or u
  modified_base (189)..(189): c or u
  modified_base (194)..(194): c or u
  modified_base (218)..(218): c or u
  modified_base (229)..(229): c or u
  modified_base (274)..(274): c or u
  modified_base (295)..(295): c or u
  modified_base (298)..(298): c or u
utngutuuuaautgtauttuttggtutuuuuuuuuauuuuungutuuuuuuuungutguttuutuutuutuutuutuututnguaguaguagtuauaguaguaguaguaguaguuuaaagggggggagagungggnggngggngggngngtuunggagnggungnggngaggutggggagauagngatngaggnggutataguuauaattaattttungagutauaggnguauautagggutgtaaaaaaatttttggtttaauutttuutaungutggguuaatuagagutggnggngt

SEQ ID NO: 87 - DNA, 300 bp, Artificial Sequence
  Description of Artificial Sequence: Synthetic oligonucleotide
  Description of Combined DNA/RNA Molecule: Synthetic oligonucleotide
  modified_base (30)..(30): c or u
  modified_base (43)..(43): c or u
  modified_base (52)..(52): c or u
  modified_base (64)..(64): c or u
  modified_base (108)..(108): c or u
  modified_base (148)..(148): c or u
  modified_base (150)..(150): c or u
  modified_base (153)..(153): c or u
  modified_base (156)..(156): c or u
  modified_base (175)..(175): c or u
  modified_base (177)..(177): c or u
  modified_base (184)..(184): c or u
  modified_base (191)..(191): c or u
  modified_base (197)..(197): c or u
  modified_base (209)..(209): c or u
  modified_base (217)..(217): c or u
  modified_base (221)..(221): c or u
  modified_base (230)..(230): c or u
  modified_base (243)..(243): c or u
  modified_base (249)..(249): c or u
  modified_base (268)..(268): c or u
  modified_base (271)..(271): c or u
  modified_base (295)..(295): c or u
agguagaataaaauuuuutuuuutagagunggggtggutuagnggaatuatngagaatgagaungutggttgutaatggguttggggaaaatgggatguaatttuuunggtgtttttuagguuuagagutattgaataaatgaagtgngngunggnggagtuagtaautuautgngnggutuungguaggngggggnggagtgggggunguagaaunggangtguutggngaggttuagaggngutagnggtgtggtgggtggguagngungggatggutggagggaggggutanggggg

SEQ ID NO: 88 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (29)..(29): c or u
  modified_base (32)..(32): c or u
  modified_base (51)..(51): c or u
  modified_base (57)..(57): c or u
  modified_base (70)..(70): c or u
  modified_base (79)..(79): c or u
  modified_base (83)..(83): c or u
  modified_base (91)..(91): c or u
  modified_base (103)..(103): c or u
  modified_base (109)..(109): c or u
  modified_base (116)..(116): c or u
  modified_base (123)..(123): c or u
  modified_base (125)..(125): c or u
  modified_base (144)..(144): c or u
  modified_base (147)..(147): c or u
  modified_base (150)..(150): c or u
  modified_base (152)..(152): c or u
  modified_base (192)..(192): c or u
  modified_base (236)..(236): c or u
  modified_base (248)..(248): c or u
  modified_base (257)..(257): c or u
  modified_base (270)..(270): c or u
uuuungtaguuuutuuutuuaguuatuunggngutguuuauuuauuauaungutagnguututgaauutnguuagguangtunggttutgngguuuuuautunguuuunguutgungggagungnguagtgagttautgautungunggngnguauttuatttattuaatagututggguutgaaaaauaunggggaaattguatuuuattttuuuuaaguuuattaguaauuagnggtutuattutngatgattungutgaguuauuunggututaggggagggggttttattutguut

SEQ ID NO: 89 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (45)..(45): c or u
  modified_base (47)..(47): c or u
  modified_base (59)..(59): c or u
  modified_base (84)..(84): c or u
  modified_base (94)..(94): c or u
  modified_base (118)..(118): c or u
  modified_base (121)..(121): c or u
  modified_base (151)..(151): c or u
  modified_base (166)..(166): c or u
  modified_base (179)..(179): c or u
  modified_base (194)..(194): c or u
  modified_base (197)..(197): c or u
  modified_base (214)..(214): c or u
  modified_base (232)..(232): c or u
  modified_base (234)..(234): c or u
  modified_base (268)..(268): c or u
uuutgungaggttatggtguutgtttuuaguagututgaguuuangnggaauatgagtngutgataaauaagguttguagttgngagggguutnggggtgggtttutggttgaggaangunggggaatggutgatggaggaaguuuutgungggaguaggaguagnggaaauutauatngguuauauagatuunggngggggagggaggguaangutuagaaguagagutgngngatgtguutttutgggutgutuaguuuaggguungagauutguttguutgaggagggguagatgua

SEQ ID NO: 90 - DNA, 300 bp, Artificial Sequence
  Description of Artificial Sequence: Synthetic oligonucleotide
  Description of Combined DNA/RNA Molecule: Synthetic oligonucleotide
  modified_base (32)..(32): c or u
  modified_base (66)..(66): c or u
  modified_base (68)..(68): c or u
  modified_base (86)..(86): c or u
  modified_base (103)..(103): c or u
  modified_base (106)..(106): c or u
  modified_base (121)..(121): c or u
  modified_base (134)..(134): c or u
  modified_base (149)..(149): c or u
  modified_base (179)..(179): c or u
  modified_base (182)..(182): c or u
  modified_base (206)..(206): c or u
  modified_base (216)..(216): c or u
  modified_base (241)..(241): c or u
  modified_base (253)..(253): c or u
  modified_base (255)..(255): c or u
  modified_base (293)..(293): c or u
tguatutguuuutuutuagguaaguaggtutnggguuutgggutgaguaguuuagaaagguauatngnguagututguttutgagngttguuutuuutuuuungungggatutgtgtggungatgtaggtttungutgutuutgutuungguagggguttuutuuatuaguuattuuunggngttuutuaauuagaaauuuauuungagguuuutnguaautguaaguuttgtttatuagngautuatgttungngtgggutuagagutgutggaaauagguauuataauutngguaggg

SEQ ID NO: 91 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (9)..(9): c or u
  modified_base (24)..(24): c or u
  modified_base (34)..(34): c or u
  modified_base (39)..(39): c or u
  modified_base (41)..(41): c or u
  modified_base (44)..(44): c or u
  modified_base (57)..(57): c or u
  modified_base (74)..(74): c or u
  modified_base (80)..(80): c or u
  modified_base (93)..(93): c or u
  modified_base (111)..(111): c or u
  modified_base (118)..(118): c or u
  modified_base (120)..(120): c or u
  modified_base (123)..(123): c or u
  modified_base (133)..(133): c or u
  modified_base (138)..(138): c or u
  modified_base (145)..(145): c or u
  modified_base (148)..(148): c or u
  modified_base (151)..(151): c or u
  modified_base (166)..(166): c or u
  modified_base (173)..(173): c or u
  modified_base (176)..(176): c or u
  modified_base (184)..(184): c or u
  modified_base (186)..(186): c or u
  modified_base (201)..(201): c or u
  modified_base (230)..(230): c or u
  modified_base (259)..(259): c or u
  modified_base (270)..(270): c or u
  modified_base (273)..(273): c or u
  modified_base (282)..(282): c or u
  modified_base (297)..(297): c or u
gguuunganguuagutgtuuuuungagaagutunguagngngtngutuuaggagtgngaggaguuatagatggngutgungtuuaguuaguungtuauutggttgguutgngggguangnggngggtgaguungggtngagaggnggnggnggguuagggaaggungggguunggngggtgtungnggutggggagtgggnguututuuuutuuagguuutguuagguungaaguuuagguuuuauutggutggggtgnggtuuuttuungunguuttuuunguutuauuaggtuunggg

SEQ ID NO: 92 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (18)..(18): c or u
  modified_base (27)..(27): c or u
  modified_base (30)..(30): c or u
  modified_base (41)..(41): c or u
  modified_base (70)..(70): c or u
  modified_base (99)..(99): c or u
  modified_base (114)..(114): c or u
  modified_base (116)..(116): c or u
  modified_base (124)..(124): c or u
  modified_base (127)..(127): c or u
  modified_base (134)..(134): c or u
  modified_base (149)..(149): c or u
  modified_base (152)..(152): c or u
  modified_base (155)..(155): c or u
  modified_base (162)..(162): c or u
  modified_base (167)..(167): c or u
  modified_base (177)..(177): c or u
  modified_base (180)..(180): c or u
  modified_base (182)..(182): c or u
  modified_base (189)..(189): c or u
  modified_base (207)..(207): c or u
  modified_base (220)..(220): c or u
  modified_base (226)..(226): c or u
  modified_base (243)..(243): c or u
  modified_base (256)..(256): c or u
  modified_base (259)..(259): c or u
  modified_base (261)..(261): c or u
  modified_base (266)..(266): c or u
  modified_base (276)..(276): c or u
  modified_base (291)..(291): c or u
  modified_base (294)..(294): c or u
uungggauutggtgaggnggggaaggnggngggaagggaunguauuuuaguuaggtgggguutggguttnggguutgguaggguutggaggggagaggnguuuautuuuuagungnggauauungunggguuungguuttuuutgguungungunguututngauungggutuauungungngtguuunguagguuaauuaggtgangggutggutggangguagnguuatutatggutuutnguautuutggagngangngutgnggaguttutnggggggauagutggngtngggguu

SEQ ID NO: 93 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (57)..(57): c or u
  modified_base (86)..(86): c or u
  modified_base (90)..(90): c or u
  modified_base (115)..(115): c or u
  modified_base (121)..(121): c or u
  modified_base (132)..(132): c or u
  modified_base (149)..(149): c or u
  modified_base (151)..(151): c or u
  modified_base (157)..(157): c or u
  modified_base (159)..(159): c or u
  modified_base (169)..(169): c or u
  modified_base (182)..(182): c or u
  modified_base (187)..(187): c or u
  modified_base (197)..(197): c or u
  modified_base (206)..(206): c or u
  modified_base (221)..(221): c or u
  modified_base (237)..(237): c or u
  modified_base (244)..(244): c or u
  modified_base (248)..(248): c or u
  modified_base (254)..(254): c or u
  modified_base (263)..(263): c or u
  modified_base (265)..(265): c or u
  modified_base (284)..(284): c or u
gtttttngtttuuaatguuutggauutttagagagutuatuatutttuuttatggtnguaagtuttgaaagaaagaguaagagagngagngggttgggttggggutggagtagungaggungguutgggtunggguagtuagguutgangngguuungnguuuttuuungguagagaaguungggangguuatgtgngtgggutgngggagtuagatuuangauuagtttatuutgngggtgtnguungauutngagtgguangngguutguutuaagtgtgungagtguaguuagtauu

SEQ ID NO: 94 - DNA, 300 bp, Artificial Sequence
  Description of Artificial Sequence: Synthetic oligonucleotide
  Description of Combined DNA/RNA Molecule: Synthetic oligonucleotide
  modified_base (16)..(16): c or u
  modified_base (35)..(35): c or u
  modified_base (37)..(37): c or u
  modified_base (46)..(46): c or u
  modified_base (52)..(52): c or u
  modified_base (56)..(56): c or u
  modified_base (63)..(63): c or u
  modified_base (79)..(79): c or u
  modified_base (94)..(94): c or u
  modified_base (103)..(103): c or u
  modified_base (113)..(113): c or u
  modified_base (118)..(118): c or u
  modified_base (131)..(131): c or u
  modified_base (141)..(141): c or u
  modified_base (143)..(143): c or u
  modified_base (149)..(149): c or u
  modified_base (151)..(151): c or u
  modified_base (168)..(168): c or u
  modified_base (179)..(179): c or u
  modified_base (185)..(185): c or u
  modified_base (210)..(210): c or u
  modified_base (214)..(214): c or u
  modified_base (243)..(243): c or u
  modified_base (293)..(293): c or u
ggtautggutguautngguauauttgagguaggungngtguuautngaggtngggngauauunguaggataaautggtngtggatutgautuunguaguuuanguauatggungtuunggguttututgunggggaagggngnggggungngtuagguutgautguunggauuuaggungguutnggutautuuaguuuuaauuuaauungutngutututtgututttutttuaagauttgngauuataaggaaagatgatgagutututaaaggtuuaggguattggaaangaaaaau

SEQ ID NO: 95 - DNA, 300 bp, Artificial Sequence
  Description of Artificial Sequence: Synthetic oligonucleotide
  Description of Combined DNA/RNA Molecule: Synthetic oligonucleotide
  modified_base (113)..(113): c or u
  modified_base (150)..(150): c or u
  modified_base (159)..(159): c or u
  modified_base (173)..(173): c or u
  modified_base (219)..(219): c or u
  modified_base (233)..(233): c or u
  modified_base (235)..(235): c or u
  modified_base (241)..(241): c or u
  modified_base (295)..(295): c or u
tgtauuutgggttuuuutautttuuuuuagttggguuuuauatutgggtutggututtaagtuttggguatatgggatagagaatttaaggatuuagatautttguaatuuungggutagtaggaggaaaagtggutuututgggaauunggatgggungaauaguaguttungguagagguuutuaggtttuagagttutuuaagtggggagaagggngguutgutuaguungnguauungtgguaguauuauagagggaataaaaguagggtaaauaatttgaagatuuuuangaagg

SEQ ID NO: 96 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (59)..(59): c or u
  modified_base (65)..(65): c or u
  modified_base (67)..(67): c or u
  modified_base (81)..(81): c or u
  modified_base (127)..(127): c or u
  modified_base (141)..(141): c or u
  modified_base (150)..(150): c or u
  modified_base (187)..(187): c or u
uuttngtggggatuttuaaattgtttauuutguttttattuuututgtggtgutguuangggtgngngggutgaguaggunguuuttutuuuuauttggagaaututgaaauutgaggguututgunggaagutgutgttngguuuatungggttuuuagaggaguuauttttuutuutautaguunggggattguaaagtatutggatuuttaaattututatuuuatatguuuaagauttaagaguuagauuuagatgtgggguuuaautgggggaaagtaggggaauuuagggtaua

SEQ ID NO: 97 - DNA, 300 bp, Artificial Sequence
  Description of Artificial Sequence: Synthetic oligonucleotide
  Description of Combined DNA/RNA Molecule: Synthetic oligonucleotide
  modified_base (13)..(13): c or u
  modified_base (49)..(49): c or u
  modified_base (100)..(100): c or u
  modified_base (119)..(119): c or u
  modified_base (126)..(126): c or u
  modified_base (139)..(139): c or u
  modified_base (142)..(142): c or u
  modified_base (151)..(151): c or u
  modified_base (197)..(197): c or u
  modified_base (263)..(263): c or u
  modified_base (266)..(266): c or u
  modified_base (287)..(287): c or u
utguutguaguungaggagutgautaatgututggagatuaguaauatngtgttuauuaguatgtttguuutggagatgutgutgaagutgutgguutgngguuututgggutauatunggaauungtauaauatuttngangguatuatngtggtuatuaggtgggtuuuuauuututuuuuaggaagagggguungggaagutuuautututgguagaaatuuuauutguagaguaaaauuuagaguauaggaggaagtangangatagututttatgauaggungtgggaaguaggt

SEQ ID NO: 98 - DNA, 300 bp, Artificial Sequence
  Description of Artificial Sequence: Synthetic oligonucleotide
  Description of Combined DNA/RNA Molecule: Synthetic oligonucleotide
  modified_base (13)..(13): c or u
  modified_base (34)..(34): c or u
  modified_base (37)..(37): c or u
  modified_base (103)..(103): c or u
  modified_base (149)..(149): c or u
  modified_base (158)..(158): c or u
  modified_base (161)..(161): c or u
  modified_base (174)..(174): c or u
  modified_base (181)..(181): c or u
  modified_base (200)..(200): c or u
  modified_base (251)..(251): c or u
  modified_base (287)..(287): c or u
auutguttuuuangguutgtuataaagagutatngtngtauttuutuutgtgututgggttttgututguaggtgggatttutguuagagagtggaguttuunggguuuututtuutggggagagggtggggauuuauutgatgauuangatgatgungtngaagatgttgtangggttunggatgtaguuuagagggunguagguuaguaguttuaguaguatutuuaggguaaauatgutggtgaauangatgttgutgatutuuagaguattagtuagutuutngggutguagguag

SEQ ID NO: 99 - DNA, 300 bp, Artificial Sequence
  Description of Artificial Sequence: Synthetic oligonucleotide
  Description of Combined DNA/RNA Molecule: Synthetic oligonucleotide
  modified_base (81)..(81): c or u
  modified_base (147)..(147): c or u
  modified_base (150)..(150): c or u
  modified_base (188)..(188): c or u
uuuuutggaaggtgutaatttutgagguutuuaggggaauaatgaggaggagaaaaatuuuagtgtgaaaatgatgtuagnggagttguttgtuuutttgtutgtutgtuutttataaguuatuuuututguagaggutgutgggunggngggautgtuuutuutuututttguuuatututttggungggtgagtutuatutuaagautuutuautgtaututuauaguttggtutuuatauaaatgaagttuauuututgggututgaaauaguttutuautuuauuuaaaaagatuu

SEQ ID NO: 100 - DNA, 300 bp, Artificial Sequence
  Description of Artificial Sequence: Synthetic oligonucleotide
  Description of Combined DNA/RNA Molecule: Synthetic oligonucleotide
  modified_base (112)..(112): c or u
  modified_base (150)..(150): c or u
  modified_base (153)..(153): c or u
  modified_base (219)..(219): c or u
ggatutttttgggtggagtgagaagutgtttuagaguuuagagggtgaauttuatttgtatggagauuaagutgtgagagtauagtgaggagtuttgagatgagautuauungguuaaagagatggguaaagaggaggagggauagtuungungguuuaguaguututguagaggggatgguttataaaggauagauagauaaagggauaaguaautungutgauatuattttuauautgggatttttutuutuutuattgttuuuutggagguutuagaaattaguauuttuuaggggg

SEQ ID NO: 101 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (4)..(4): c or u
  modified_base (16)..(16): c or u
  modified_base (23)..(23): c or u
  modified_base (50)..(50): c or u
  modified_base (56)..(56): c or u
  modified_base (63)..(63): c or u
  modified_base (76)..(76): c or u
  modified_base (105)..(105): c or u
  modified_base (113)..(113): c or u
  modified_base (117)..(117): c or u
  modified_base (121)..(121): c or u
  modified_base (129)..(129): c or u
  modified_base (135)..(135): c or u
  modified_base (140)..(140): c or u
  modified_base (150)..(150): c or u
  modified_base (154)..(154): c or u
  modified_base (166)..(166): c or u
  modified_base (169)..(169): c or u
  modified_base (172)..(172): c or u
  modified_base (176)..(176): c or u
  modified_base (197)..(197): c or u
  modified_base (199)..(199): c or u
  modified_base (203)..(203): c or u
  modified_base (208)..(208): c or u
  modified_base (216)..(216): c or u
  modified_base (229)..(229): c or u
  modified_base (231)..(231): c or u
  modified_base (240)..(240): c or u
  modified_base (244)..(244): c or u
  modified_base (250)..(250): c or u
  modified_base (267)..(267): c or u
  modified_base (269)..(269): c or u
  modified_base (279)..(279): c or u
  modified_base (291)..(291): c or u
  modified_base (299)..(299): c or u
ngtngtagttggggungaggtungtgtggtaggggautgggauaggagtnggagtnguagggngaggguuuagatnggggutggaaguuauagguututuauutnguttggungagnggungggautunggguunguagnggatggaagngggngutguuutguunggnggnggungggguuttutggggttttuungngggnggutngguagggngguaguagutgungnggagaggangaunguuaunggtguaauuaggtuuungnguuuutguungguututggggnguuuaagng

SEQ ID NO: 102 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (9)..(9): c or u
  modified_base (21)..(21): c or u
  modified_base (31)..(31): c or u
  modified_base (33)..(33): c or u
  modified_base (50)..(50): c or u
  modified_base (56)..(56): c or u
  modified_base (60)..(60): c or u
  modified_base (69)..(69): c or u
  modified_base (71)..(71): c or u
  modified_base (84)..(84): c or u
  modified_base (92)..(92): c or u
  modified_base (97)..(97): c or u
  modified_base (101)..(101): c or u
  modified_base (103)..(103): c or u
  modified_base (124)..(124): c or u
  modified_base (128)..(128): c or u
  modified_base (131)..(131): c or u
  modified_base (134)..(134): c or u
  modified_base (146)..(146): c or u
  modified_base (150)..(150): c or u
  modified_base (160)..(160): c or u
  modified_base (165)..(165): c or u
  modified_base (171)..(171): c or u
  modified_base (179)..(179): c or u
  modified_base (183)..(183): c or u
  modified_base (187)..(187): c or u
  modified_base (195)..(195): c or u
  modified_base (224)..(224): c or u
  modified_base (237)..(237): c or u
  modified_base (244)..(244): c or u
  modified_base (250)..(250): c or u
  modified_base (277)..(277): c or u
  modified_base (284)..(284): c or u
  modified_base (296)..(296): c or u
  modified_base (299)..(299): c or u
nguttgggnguuuuagaggunggguaggggngnggggauutggttguaunggtggnggtngtuututungngguagutgutgunguuutgungagunguungngggaaaauuuuagaagguuunggungungunggguaggguagnguunguttuuatungutgnggguunggagtuunggungutngguuaagngaggtgagagguutgtgguttuuaguuungatutggguuutnguuutgngautungautuutgtuuuagtuuuutauuauanggauutngguuuuaautangang

SEQ ID NO: 103 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (8)..(8): c or u
  modified_base (16)..(16): c or u
  modified_base (19)..(19): c or u
  modified_base (22)..(22): c or u
  modified_base (26)..(26): c or u
  modified_base (39)..(39): c or u
  modified_base (87)..(87): c or u
  modified_base (90)..(90): c or u
  modified_base (106)..(106): c or u
  modified_base (111)..(111): c or u
  modified_base (116)..(116): c or u
  modified_base (119)..(119): c or u
  modified_base (150)..(150): c or u
  modified_base (152)..(152): c or u
  modified_base (156)..(156): c or u
  modified_base (177)..(177): c or u
  modified_base (179)..(179): c or u
  modified_base (184)..(184): c or u
  modified_base (188)..(188): c or u
  modified_base (190)..(190): c or u
  modified_base (196)..(196): c or u
  modified_base (199)..(199): c or u
  modified_base (204)..(204): c or u
  modified_base (206)..(206): c or u
  modified_base (209)..(209): c or u
  modified_base (214)..(214): c or u
  modified_base (223)..(223): c or u
  modified_base (226)..(226): c or u
  modified_base (240)..(240): c or u
  modified_base (245)..(245): c or u
  modified_base (293)..(293): c or u
nguaggunguagtgangtnggngggngutguattaaggngaggggguttuuagagutuaguuaauaguuaggaguagtgauuaagungunggagutggggagaganguaunggggnggngautggguuaggagauuagggautgagggangnguunggggaggguuaguaauaagungngguungggngngauagnggnggtungngungagungttuuagungungguutautgtagungutgnguuaggauatttttttttaaagututuuaagutguuuuuutuutuuungautuut

SEQ ID NO: 104 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (55)..(55): c or u
  modified_base (60)..(60): c or u
  modified_base (74)..(74): c or u
  modified_base (77)..(77): c or u
  modified_base (86)..(86): c or u
  modified_base (91)..(91): c or u
  modified_base (94)..(94): c or u
  modified_base (96)..(96): c or u
  modified_base (101)..(101): c or u
  modified_base (104)..(104): c or u
  modified_base (110)..(110): c or u
  modified_base (112)..(112): c or u
  modified_base (116)..(116): c or u
  modified_base (121)..(121): c or u
  modified_base (123)..(123): c or u
  modified_base (144)..(144): c or u
  modified_base (148)..(148): c or u
  modified_base (150)..(150): c or u
  modified_base (181)..(181): c or u
  modified_base (184)..(184): c or u
  modified_base (189)..(189): c or u
  modified_base (194)..(194): c or u
  modified_base (210)..(210): c or u
  modified_base (213)..(213): c or u
  modified_base (261)..(261): c or u
  modified_base (274)..(274): c or u
  modified_base (278)..(278): c or u
  modified_base (281)..(281): c or u
  modified_base (284)..(284): c or u
  modified_base (292)..(292): c or u
  modified_base (299)..(299): c or u
aggagtnggggaggagggggguaguttggagagutttaaaaaaaaatgtuutggnguagnggutauagtaggunggnggutggaanggutnggngnggaungungutgtngnguungggungngguttgttgutgguuutuuungggngngtuuutuagtuuutggtutuutgguuuagtngunguuunggtgngtututuuuuagutunggngguttggtuautgutuutggutgttggutgagututggaaguuuuutnguuttaatguagnguungungangtuautgngguutgng

SEQ ID NO: 105 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (7)..(7): c or u
  modified_base (13)..(13): c or u
  modified_base (24)..(24): c or u
  modified_base (37)..(37): c or u
  modified_base (44)..(44): c or u
  modified_base (49)..(49): c or u
  modified_base (51)..(51): c or u
  modified_base (58)..(58): c or u
  modified_base (61)..(61): c or u
  modified_base (64)..(64): c or u
  modified_base (67)..(67): c or u
  modified_base (73)..(73): c or u
  modified_base (83)..(83): c or u
  modified_base (86)..(86): c or u
  modified_base (90)..(90): c or u
  modified_base (96)..(96): c or u
  modified_base (108)..(108): c or u
  modified_base (113)..(113): c or u
  modified_base (117)..(117): c or u
  modified_base (122)..(122): c or u
  modified_base (134)..(134): c or u
  modified_base (136)..(136): c or u
  modified_base (146)..(146): c or u
  modified_base (151)..(151): c or u
  modified_base (153)..(153): c or u
  modified_base (155)..(155): c or u
  modified_base (163)..(163): c or u
  modified_base (166)..(166): c or u
  modified_base (187)..(187): c or u
  modified_base (194)..(194): c or u
  modified_base (196)..(196): c or u
  modified_base (200)..(200): c or u
  modified_base (208)..(208): c or u
  modified_base (220)..(220): c or u
  modified_base (229)..(229): c or u
  modified_base (272)..(272): c or u
  modified_base (283)..(283): c or u
  modified_base (294)..(294): c or u
  modified_base (296)..(296): c or u
  modified_base (299)..(299): c or u
nguuutngguuunguuuuutguunguuuutuuututnggggtunggggngngagutgnggnggnggngguuanggtuattggngungagnggttunggutgautgganggggngggngtuunggguaguutagngnggtauutuunguuungngnguuuagunggngagggauattggauuagggtngggggtngnggungutuuagngaggtaagagungggaagaungggagagauuauututtuuatuutgggggggtuuutggggganggtutuuuaunggtgutgggungnggng

SEQ ID NO: 106 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (4)..(4): c or u
  modified_base (6)..(6): c or u
  modified_base (17)..(17): c or u
  modified_base (28)..(28): c or u
  modified_base (71)..(71): c or u
  modified_base (80)..(80): c or u
  modified_base (92)..(92): c or u
  modified_base (100)..(100): c or u
  modified_base (104)..(104): c or u
  modified_base (106)..(106): c or u
  modified_base (113)..(113): c or u
  modified_base (134)..(134): c or u
  modified_base (137)..(137): c or u
  modified_base (145)..(145): c or u
  modified_base (147)..(147): c or u
  modified_base (149)..(149): c or u
  modified_base (154)..(154): c or u
  modified_base (164)..(164): c or u
  modified_base (166)..(166): c or u
  modified_base (178)..(178): c or u
  modified_base (183)..(183): c or u
  modified_base (187)..(187): c or u
  modified_base (192)..(192): c or u
  modified_base (204)..(204): c or u
  modified_base (210)..(210): c or u
  modified_base (214)..(214): c or u
  modified_base (217)..(217): c or u
  modified_base (227)..(227): c or u
  modified_base (233)..(233): c or u
  modified_base (236)..(236): c or u
  modified_base (239)..(239): c or u
  modified_base (242)..(242): c or u
  modified_base (249)..(249): c or u
  modified_base (251)..(251): c or u
  modified_base (256)..(256): c or u
  modified_base (263)..(263): c or u
  modified_base (276)..(276): c or u
  modified_base (287)..(287): c or u
  modified_base (293)..(293): c or u
  modified_base (299)..(299): c or u
ngungngguuuaguaunggtgggagaungtuuuuuagggauuuuuuuaggatggaagaggtggtututuunggtuttuunggututtauutngutggagnggungngauuuungauuutggtuuaatgtuuutngunggutgggngngnggggngggaggtaungngutaggutguunggganguunguuungtuuagtuagunggaaungutnggnguuaatgaungtggungungungunguagutngnguuunggauuungagagggaggggnggguagggggnggggungagggng

SEQ ID NO: 107 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (8)..(8): c or u
  modified_base (13)..(13): c or u
  modified_base (23)..(23): c or u
  modified_base (26)..(26): c or u
  modified_base (31)..(31): c or u
  modified_base (38)..(38): c or u
  modified_base (45)..(45): c or u
  modified_base (59)..(59): c or u
  modified_base (70)..(70): c or u
  modified_base (81)..(81): c or u
  modified_base (89)..(89): c or u
  modified_base (102)..(102): c or u
  modified_base (112)..(112): c or u
  modified_base (123)..(123): c or u
  modified_base (126)..(126): c or u
  modified_base (128)..(128): c or u
  modified_base (140)..(140): c or u
  modified_base (150)..(150): c or u
  modified_base (159)..(159): c or u
  modified_base (166)..(166): c or u
  modified_base (174)..(174): c or u
  modified_base (178)..(178): c or u
  modified_base (180)..(180): c or u
  modified_base (182)..(182): c or u
  modified_base (193)..(193): c or u
  modified_base (195)..(195): c or u
  modified_base (201)..(201): c or u
  modified_base (207)..(207): c or u
  modified_base (216)..(216): c or u
  modified_base (237)..(237): c or u
  modified_base (246)..(246): c or u
  modified_base (274)..(274): c or u
  modified_base (293)..(293): c or u
  modified_base (299)..(299): c or u
nguuutungguungguutuutungungguunggutuungagaggnguaguuagututunguuatgtutgnggggaututungagggggnggtuaguatuuangggutgagungggggtgguungungngutututgguungutgagtuunguagutuungttauangguutuunggangngnguttuuatutngngauuungggggnguutuutungaataagtatgtggtguutgngaggauuanggtgggagutgaguautauuuuauuuungaggggauagtgtgtgtanggggang

SEQ ID NO: 108 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (7)..(7): c or u
  modified_base (26)..(26): c or u
  modified_base (54)..(54): c or u
  modified_base (63)..(63): c or u
  modified_base (84)..(84): c or u
  modified_base (93)..(93): c or u
  modified_base (99)..(99): c or u
  modified_base (105)..(105): c or u
  modified_base (107)..(107): c or u
  modified_base (118)..(118): c or u
  modified_base (120)..(120): c or u
  modified_base (122)..(122): c or u
  modified_base (126)..(126): c or u
  modified_base (134)..(134): c or u
  modified_base (141)..(141): c or u
  modified_base (150)..(150): c or u
  modified_base (160)..(160): c or u
  modified_base (172)..(172): c or u
  modified_base (174)..(174): c or u
  modified_base (177)..(177): c or u
  modified_base (188)..(188): c or u
  modified_base (198)..(198): c or u
  modified_base (211)..(211): c or u
  modified_base (219)..(219): c or u
  modified_base (230)..(230): c or u
  modified_base (241)..(241): c or u
  modified_base (255)..(255): c or u
  modified_base (262)..(262): c or u
  modified_base (269)..(269): c or u
  modified_base (274)..(274): c or u
  modified_base (277)..(277): c or u
  modified_base (287)..(287): c or u
  modified_base (292)..(292): c or u
  modified_base (299)..(299): c or u
ngtuuungtauauauautgtuuuutngggggtggggtagtgutuagutuuuaungtggtuutnguagguauuauatauttattnggaggaggnguuuunggggtngngagatggaagngngngtungggaggungtgtaangggagutgngggautuagnggguuagagagngnggnggguuauuuunggutuaguungtggatgutgaunguuuuutnggagagtuuunguagauatggnggagagutggutgnguututngggagungggunggnggaggaggungggunggagggng

SEQ ID NO: 109 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (42)..(42): c or u
  modified_base (76)..(76): c or u
  modified_base (78)..(78): c or u
  modified_base (114)..(114): c or u
  modified_base (116)..(116): c or u
  modified_base (120)..(120): c or u
  modified_base (130)..(130): c or u
  modified_base (150)..(150): c or u
  modified_base (153)..(153): c or u
  modified_base (172)..(172): c or u
  modified_base (182)..(182): c or u
  modified_base (187)..(187): c or u
  modified_base (191)..(191): c or u
  modified_base (206)..(206): c or u
  modified_base (226)..(226): c or u
  modified_base (274)..(274): c or u
  modified_base (276)..(276): c or u
  modified_base (283)..(283): c or u
  modified_base (295)..(295): c or u
  modified_base (298)..(298): c or u
nggggtguagaggtaagaatggggguagaaaauuuuuaggtngtggtuutggguuuagaaagttguuuuaguutgngnguuuuttuuuaguuuutuagggtuuttuutuauuungngganggtuuuatungggtgguaaagttagtgtgnggnguuttggagutuuuuutunggtuuutuungtuunguungtutguuuutaggtnggutauuuuuuaauuuutunguutgtguuauuututuuuuaguutttggtgguautgututuutuuungnggggutnggguutggutunganga

SEQ ID NO: 110 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (5)..(5): c or u
  modified_base (17)..(17): c or u
  modified_base (24)..(24): c or u
  modified_base (26)..(26): c or u
  modified_base (74)..(74): c or u
  modified_base (94)..(94): c or u
  modified_base (109)..(109): c or u
  modified_base (113)..(113): c or u
  modified_base (118)..(118): c or u
  modified_base (128)..(128): c or u
  modified_base (147)..(147): c or u
  modified_base (150)..(150): c or u
  modified_base (170)..(170): c or u
  modified_base (180)..(180): c or u
  modified_base (184)..(184): c or u
  modified_base (186)..(186): c or u
  modified_base (222)..(222): c or u
  modified_base (224)..(224): c or u
  modified_base (258)..(258): c or u
  modified_base (299)..(299): c or u
tngtnggaguuagguungaguuungnggggaggagaguagtguuauuaaaggutggggagagggtgguauaggnggaggggttggggggtagungauutagggguagangggngggangggagggaunggagggggagutuuaaggngunguauautaautttguuauunggatgggaungtungnggggtgaggaaggauuutgaggggutgggaaggggngnguaggutgggguaautttutggguuuaggauuangauutgggggttttutguuuuuattuttauututguauuung

SEQ ID NO: 111 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (37)..(37): c or u
  modified_base (39)..(39): c or u
  modified_base (48)..(48): c or u
  modified_base (55)..(55): c or u
  modified_base (97)..(97): c or u
  modified_base (113)..(113): c or u
  modified_base (117)..(117): c or u
  modified_base (147)..(147): c or u
  modified_base (154)..(154): c or u
  modified_base (177)..(177): c or u
  modified_base (193)..(193): c or u
  modified_base (196)..(196): c or u
  modified_base (202)..(202): c or u
  modified_base (206)..(206): c or u
  modified_base (215)..(215): c or u
  modified_base (219)..(219): c or u
  modified_base (222)..(222): c or u
  modified_base (228)..(228): c or u
  modified_base (241)..(241): c or u
  modified_base (260)..(260): c or u
  modified_base (262)..(262): c or u
  modified_base (275)..(275): c or u
  modified_base (278)..(278): c or u
  modified_base (281)..(281): c or u
  modified_base (284)..(284): c or u
  modified_base (286)..(286): c or u
ggtaatttngguuuuutgaguttgguttagtttttungngaagtguangggggungttttaggatauuuagutuuuauutggagutuuagagutuunggggauuuuuttgtunguungtutuutaggguutgguautuuutgguuunguaguunggggauutuuauuttuuuuaggngguaguuauaggtuungunggguungtungaggtutgnggungungaagtnggggtutuagggngtuagggaguaauuaggungnggggagggaggunggngunggngnggaatttutttatu

SEQ ID NO: 112 - DNA, 300 bp, Artificial Sequence
  Description of Artificial Sequence: Synthetic oligonucleotide
  Description of Combined DNA/RNA Molecule: Synthetic oligonucleotide
  modified_base (14)..(14): c or u
  modified_base (16)..(16): c or u
  modified_base (19)..(19): c or u
  modified_base (22)..(22): c or u
  modified_base (25)..(25): c or u
  modified_base (38)..(38): c or u
  modified_base (40)..(40): c or u
  modified_base (59)..(59): c or u
  modified_base (72)..(72): c or u
  modified_base (78)..(78): c or u
  modified_base (81)..(81): c or u
  modified_base (85)..(85): c or u
  modified_base (94)..(94): c or u
  modified_base (98)..(98): c or u
  modified_base (104)..(104): c or u
  modified_base (107)..(107): c or u
  modified_base (123)..(123): c or u
  modified_base (146)..(146): c or u
  modified_base (153)..(153): c or u
  modified_base (183)..(183): c or u
  modified_base (187)..(187): c or u
  modified_base (203)..(203): c or u
  modified_base (245)..(245): c or u
  modified_base (252)..(252): c or u
  modified_base (261)..(261): c or u
  modified_base (263)..(263): c or u
  modified_base (291)..(291): c or u
gataaagaaattungngunggngungguutuuutuuungngguutggttgutuuutganguuutgagauuungauttnggnggunguagauutngganggguunggngggauutgtggutgunguutggggaaggtggaggtuuungggutgngggguuagggagtguuagguuutaggagangggnggauaagggggtuuungggagututggagutuuaggtgggagutgggtatuutaaaangguuuungtguauttngnggaaaaautaaguuaagutuagggggungaaattauu

SEQ ID NO: 113 - DNA, 300 bp, Artificial Sequence
  Description of Artificial Sequence: Synthetic oligonucleotide
  Description of Combined DNA/RNA Molecule: Synthetic oligonucleotide
  modified_base (28)..(28): c or u
  modified_base (40)..(40): c or u
  modified_base (55)..(55): c or u
  modified_base (59)..(59): c or u
  modified_base (65)..(65): c or u
  modified_base (70)..(70): c or u
  modified_base (86)..(86): c or u
  modified_base (110)..(110): c or u
  modified_base (113)..(113): c or u
  modified_base (122)..(122): c or u
  modified_base (124)..(124): c or u
  modified_base (132)..(132): c or u
  modified_base (135)..(135): c or u
  modified_base (137)..(137): c or u
  modified_base (143)..(143): c or u
  modified_base (151)..(151): c or u
  modified_base (168)..(168): c or u
  modified_base (178)..(178): c or u
  modified_base (198)..(198): c or u
  modified_base (254)..(254): c or u
  modified_base (256)..(256): c or u
  modified_base (266)..(266): c or u
  modified_base (275)..(275): c or u
  modified_base (295)..(295): c or u
agattgggaatutggagggtaaaatgungggtuuuttuungaguuuttagaguungaangttgtngaatnggtuaatgtuuauuungutgutuauututgtuuuaguagngungggguuagngnguuutuungungngtutgnggagutgngggaaaaguaggtuuunggggggtatngagtgtuuagggatatuuanguagauatuuttgtauttguaaatauaaagaaauauauaggauagagatuaggutngnguuagggutngatutuutnggggutuagggttggaggungtaua

SEQ ID NO: 114 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (25)..(25): c or u
  modified_base (34)..(34): c or u
  modified_base (44)..(44): c or u
  modified_base (46)..(46): c or u
  modified_base (102)..(102): c or u
  modified_base (122)..(122): c or u
  modified_base (132)..(132): c or u
  modified_base (149)..(149): c or u
  modified_base (157)..(157): c or u
  modified_base (163)..(163): c or u
  modified_base (165)..(165): c or u
  modified_base (168)..(168): c or u
  modified_base (176)..(176): c or u
  modified_base (178)..(178): c or u
  modified_base (187)..(187): c or u
  modified_base (190)..(190): c or u
  modified_base (214)..(214): c or u
  modified_base (230)..(230): c or u
  modified_base (235)..(235): c or u
  modified_base (241)..(241): c or u
  modified_base (245)..(245): c or u
  modified_base (260)..(260): c or u
  modified_base (272)..(272): c or u
tgtangguutuuaauuutgaguuungaggagatngaguuutggngngaguutgatututgtuutgtgtgtttutttgtatttguaagtauaaggatgtutgngtggatatuuutggauautngatauuuuunggggauutguttttuunguagutunguagangnggngggagggngngutgguuunggngutgutgggauagaggtgaguagnggggtggauattgaungattngauaangttngggututaagggutngggaagggauungguattttauuutuuagattuuuaatut

SEQ ID NO: 115 - DNA, 300 bp, Artificial Sequence
  Description of Artificial Sequence: Synthetic oligonucleotide
  Description of Combined DNA/RNA Molecule: Synthetic oligonucleotide
  modified_base (11)..(11): c or u
  modified_base (14)..(14): c or u
  modified_base (21)..(21): c or u
  modified_base (53)..(53): c or u
  modified_base (56)..(56): c or u
  modified_base (60)..(60): c or u
  modified_base (62)..(62): c or u
  modified_base (84)..(84): c or u
  modified_base (95)..(95): c or u
  modified_base (98)..(98): c or u
  modified_base (105)..(105): c or u
  modified_base (122)..(122): c or u
  modified_base (128)..(128): c or u
  modified_base (132)..(132): c or u
  modified_base (150)..(150): c or u
  modified_base (169)..(169): c or u
  modified_base (171)..(171): c or u
  modified_base (191)..(191): c or u
  modified_base (198)..(198): c or u
  modified_base (204)..(204): c or u
  modified_base (206)..(206): c or u
  modified_base (210)..(210): c or u
  modified_base (212)..(212): c or u
  modified_base (218)..(218): c or u
  modified_base (224)..(224): c or u
  modified_base (227)..(227): c or u
  modified_base (248)..(248): c or u
  modified_base (251)..(251): c or u
  modified_base (267)..(267): c or u
  modified_base (269)..(269): c or u
  modified_base (272)..(272): c or u
  modified_base (276)..(276): c or u
aggguutuagnggngguauunguatuututttuttatgguauaagutgaaggnggnggungngguagggaaggtgtaggggtgngggaagaguungunguaguungggaauttutguagganguuuungaangaguuuttgutggguaungggatgautgggtagutgngnggguutttgguuuutguuungguauunguuuungnguungnguuuanguuuangungguuauauaguuauuuuuagngunguuuuuauuagtuuungngunguungaaguaguaguuauagagaggutg

SEQ ID NO: 116 - DNA, 300 bp, Artificial Sequence
  Description of Artificial Sequence: Synthetic oligonucleotide
  Description of Combined DNA/RNA Molecule: Synthetic oligonucleotide
  modified_base (24)..(24): c or u
  modified_base (28)..(28): c or u
  modified_base (31)..(31): c or u
  modified_base (33)..(33): c or u
  modified_base (49)..(49): c or u
  modified_base (52)..(52): c or u
  modified_base (73)..(73): c or u
  modified_base (76)..(76): c or u
  modified_base (82)..(82): c or u
  modified_base (88)..(88): c or u
  modified_base (90)..(90): c or u
  modified_base (94)..(94): c or u
  modified_base (96)..(96): c or u
  modified_base (102)..(102): c or u
  modified_base (109)..(109): c or u
  modified_base (129)..(129): c or u
  modified_base (131)..(131): c or u
  modified_base (150)..(150): c or u
  modified_base (168)..(168): c or u
  modified_base (172)..(172): c or u
  modified_base (178)..(178): c or u
  modified_base (195)..(195): c or u
  modified_base (202)..(202): c or u
  modified_base (205)..(205): c or u
  modified_base (216)..(216): c or u
  modified_base (238)..(238): c or u
  modified_base (240)..(240): c or u
  modified_base (244)..(244): c or u
  modified_base (247)..(247): c or u
  modified_base (279)..(279): c or u
  modified_base (286)..(286): c or u
  modified_base (289)..(289): c or u
uaguutututgtggutgutguttngggnggngnggggautggtgggggnggngutgggggtggutgtgtggunggngtgggngtgggngngggngngggggngggtgungggguagggguuaaagguungnguagutauuuagtuatuunggtguuuaguaagggutngttngggggngtuutguagaagttuungggutgnggngggututtuunguauuuutauauuttuuutgungnggungunguuttuaguttgtguuataagaaagaggatgngggtgungungutgagguuut

SEQ ID NO: 117 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (10)..(10): c or u
  modified_base (13)..(13): c or u
  modified_base (20)..(20): c or u
  modified_base (44)..(44): c or u
  modified_base (47)..(47): c or u
  modified_base (49)..(49): c or u
  modified_base (72)..(72): c or u
  modified_base (74)..(74): c or u
  modified_base (93)..(93): c or u
  modified_base (95)..(95): c or u
  modified_base (115)..(115): c or u
  modified_base (127)..(127): c or u
  modified_base (137)..(137): c or u
  modified_base (151)..(151): c or u
  modified_base (170)..(170): c or u
  modified_base (175)..(175): c or u
  modified_base (192)..(192): c or u
  modified_base (194)..(194): c or u
  modified_base (198)..(198): c or u
  modified_base (208)..(208): c or u
  modified_base (217)..(217): c or u
  modified_base (223)..(223): c or u
  modified_base (235)..(235): c or u
  modified_base (238)..(238): c or u
  modified_base (279)..(279): c or u
  modified_base (289)..(289): c or u
autanggtungunggguuangauaaaatgutuaguuuuaauttngangnguauuauautguuatgutgauungnggtgaguaauauutgtuungngguutggguauuuuauutgngguuatgatgtnguauutgaangguutguauuauunggguuauautuagtutuangggunggtgutgguauuuagtngngagngguuauuutngtuutuatngggutnguaggtgguuangtnggguuagutggaagaaatuaauauuaaagaggtgguuuagnguatuauagnggagutgaagu

SEQ ID NO: 118 - DNA, 300 bp, Artificial Sequence
  Description of Artificial Sequence: Synthetic oligonucleotide
  Description of Combined DNA/RNA Molecule: Synthetic oligonucleotide
  modified_base (11)..(11): c or u
  modified_base (21)..(21): c or u
  modified_base (62)..(62): c or u
  modified_base (65)..(65): c or u
  modified_base (77)..(77): c or u
  modified_base (83)..(83): c or u
  modified_base (92)..(92): c or u
  modified_base (102)..(102): c or u
  modified_base (106)..(106): c or u
  modified_base (108)..(108): c or u
  modified_base (125)..(125): c or u
  modified_base (130)..(130): c or u
  modified_base (149)..(149): c or u
  modified_base (163)..(163): c or u
  modified_base (173)..(173): c or u
  modified_base (185)..(185): c or u
  modified_base (205)..(205): c or u
  modified_base (207)..(207): c or u
  modified_base (226)..(226): c or u
  modified_base (228)..(228): c or u
  modified_base (251)..(251): c or u
  modified_base (253)..(253): c or u
  modified_base (256)..(256): c or u
  modified_base (280)..(280): c or u
  modified_base (287)..(287): c or u
  modified_base (290)..(290): c or u
  modified_base (295)..(295): c or u
guttuagutungutgtgatgngutggguuauututttggtgttgatttuttuuagutgguungangtgguuauutgngaguungatgaggangagggtggungutngngautgggtguuaguaungguungtgagautgagtgtgguungggtggtguaggungttuaggtgngauatuatggunguaggtggggtguuuaggungngggauaggtgttgutuaungngggtuaguatgguagtgtggtgngngtngaagttggggutgaguattttgtngtgguunggnggaungtagt

SEQ ID NO: 119 - DNA, 300 bp, Artificial Sequence
  Description of Artificial Sequence: Synthetic oligonucleotide
  Description of Combined DNA/RNA Molecule: Synthetic oligonucleotide
  modified_base (71)..(71): c or u
  modified_base (76)..(76): c or u
  modified_base (109)..(109): c or u
  modified_base (122)..(122): c or u
  modified_base (126)..(126): c or u
  modified_base (134)..(134): c or u
  modified_base (138)..(138): c or u
  modified_base (147)..(147): c or u
  modified_base (150)..(150): c or u
  modified_base (155)..(155): c or u
  modified_base (158)..(158): c or u
  modified_base (171)..(171): c or u
  modified_base (174)..(174): c or u
  modified_base (184)..(184): c or u
  modified_base (205)..(205): c or u
  modified_base (210)..(210): c or u
  modified_base (216)..(216): c or u
  modified_base (221)..(221): c or u
  modified_base (225)..(225): c or u
  modified_base (238)..(238): c or u
  modified_base (255)..(255): c or u
  modified_base (272)..(272): c or u
tggggtuagtagatuagtututtuagauautgatguagaagutgggautggtaagtaggtattatgtgutnggagngutaggggauaggaguaaatggagaagaaaagnggaggutttutunguunggagtatngatnggaatuuungunggtangunguagaggguuutngungttggguuungggggtttaauaaguuuagungutunguaggnggutnggunggaututuagaunggtguutggaagauaungtuuutguuuuuutuunguuaaauutguututtututttututua

SEQ ID NO: 120 - DNA, 300 bp, Artificial Sequence
  Description of Artificial Sequence: Synthetic oligonucleotide
  Description of Combined DNA/RNA Molecule: Synthetic oligonucleotide
  modified_base (28)..(28): c or u
  modified_base (45)..(45): c or u
  modified_base (62)..(62): c or u
  modified_base (75)..(75): c or u
  modified_base (79)..(79): c or u
  modified_base (84)..(84): c or u
  modified_base (90)..(90): c or u
  modified_base (95)..(95): c or u
  modified_base (116)..(116): c or u
  modified_base (126)..(126): c or u
  modified_base (129)..(129): c or u
  modified_base (142)..(142): c or u
  modified_base (145)..(145): c or u
  modified_base (150)..(150): c or u
  modified_base (153)..(153): c or u
  modified_base (162)..(162): c or u
  modified_base (166)..(166): c or u
  modified_base (174)..(174): c or u
  modified_base (178)..(178): c or u
  modified_base (191)..(191): c or u
  modified_base (224)..(224): c or u
  modified_base (229)..(229): c or u
tgagagaaagagaagagguaggtttggngggagggggguaggganggtgtuttuuagguaunggtutgagagtunggungagunguutgnggagnggutggguttgttaaauuuungggguuuaanggngaggguuututgnggngtaunggnggggattungatngatautungggnggagaaaguutunguttttuttutuuatttgutuutgtuuuutagngutungaguauataatauutauttauuagtuuuaguttutguatuagtgtutgaagagautgatutautgauuuua

SEQ ID NO: 121 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (14)..(14): c or u
  modified_base (29)..(29): c or u
  modified_base (39)..(39): c or u
  modified_base (46)..(46): c or u
  modified_base (51)..(51): c or u
  modified_base (55)..(55): c or u
  modified_base (63)..(63): c or u
  modified_base (69)..(69): c or u
  modified_base (82)..(82): c or u
  modified_base (85)..(85): c or u
  modified_base (87)..(87): c or u
  modified_base (108)..(108): c or u
  modified_base (113)..(113): c or u
  modified_base (117)..(117): c or u
  modified_base (128)..(128): c or u
  modified_base (132)..(132): c or u
  modified_base (135)..(135): c or u
  modified_base (139)..(139): c or u
  modified_base (149)..(149): c or u
  modified_base (151)..(151): c or u
  modified_base (154)..(154): c or u
  modified_base (157)..(157): c or u
  modified_base (160)..(160): c or u
  modified_base (177)..(177): c or u
  modified_base (184)..(184): c or u
  modified_base (187)..(187): c or u
  modified_base (190)..(190): c or u
  modified_base (193)..(193): c or u
  modified_base (195)..(195): c or u
  modified_base (201)..(201): c or u
  modified_base (209)..(209): c or u
  modified_base (211)..(211): c or u
  modified_base (214)..(214): c or u
  modified_base (216)..(216): c or u
  modified_base (218)..(218): c or u
  modified_base (225)..(225): c or u
  modified_base (228)..(228): c or u
  modified_base (232)..(232): c or u
  modified_base (239)..(239): c or u
  modified_base (246)..(246): c or u
  modified_base (251)..(251): c or u
  modified_base (256)..(256): c or u
  modified_base (261)..(261): c or u
  modified_base (267)..(267): c or u
  modified_base (273)..(273): c or u
  modified_base (284)..(284): c or u
  modified_base (289)..(289): c or u
agutungaguuuangutguaguuagatunggatgagtungtuutunguuungggngggututngututngutgguuutuagngungnguaguuaguaguatuuuuaungtgangutnguatuauauungggngunggunguuauuatungngungungungtuaggauuutuutuunggguatngtngungungnggggtngggaggangnggngngngggaggnggnggtnguagggngaguuunggganguuungagunggggunggggunggggagagggnguagngaggtgggggu

SEQ ID NO: 122 - DNA, 300 bp, Artificial Sequence
  Description of Artificial Sequence: Synthetic oligonucleotide
  Description of Combined DNA/RNA Molecule: Synthetic oligonucleotide
  modified_base (11)..(11): c or u
  modified_base (16)..(16): c or u
  modified_base (27)..(27): c or u
  modified_base (33)..(33): c or u
  modified_base (39)..(39): c or u
  modified_base (44)..(44): c or u
  modified_base (49)..(49): c or u
  modified_base (54)..(54): c or u
  modified_base (61)..(61): c or u
  modified_base (68)..(68): c or u
  modified_base (72)..(72): c or u
  modified_base (75)..(75): c or u
  modified_base (82)..(82): c or u
  modified_base (84)..(84): c or u
  modified_base (86)..(86): c or u
  modified_base (89)..(89): c or u
  modified_base (91)..(91): c or u
  modified_base (99)..(99): c or u
  modified_base (105)..(105): c or u
  modified_base (107)..(107): c or u
  modified_base (110)..(110): c or u
  modified_base (113)..(113): c or u
  modified_base (116)..(116): c or u
  modified_base (123)..(123): c or u
  modified_base (140)..(140): c or u
  modified_base (143)..(143): c or u
  modified_base (146)..(146): c or u
  modified_base (149)..(149): c or u
  modified_base (151)..(151): c or u
  modified_base (161)..(161): c or u
  modified_base (165)..(165): c or u
  modified_base (168)..(168): c or u
  modified_base (172)..(172): c or u
  modified_base (183)..(183): c or u
  modified_base (187)..(187): c or u
  modified_base (192)..(192): c or u
  modified_base (213)..(213): c or u
  modified_base (215)..(215): c or u
  modified_base (218)..(218): c or u
  modified_base (231)..(231): c or u
  modified_base (237)..(237): c or u
  modified_base (245)..(245): c or u
  modified_base (249)..(249): c or u
  modified_base (254)..(254): c or u
  modified_base (261)..(261): c or u
  modified_base (271)..(271): c or u
  modified_base (286)..(286): c or u
  modified_base (294)..(294): c or u
guuuuuauutngutgnguuututuuungguuungguuunggutnggggngtuunggggutnguuutgngaungunguutuungngngungngtuutuungauuungnggnggngangatguungggaggagggtuutganggnggnggngnggatggtggnggunggnguungggtgtgatgngagngtuanggtggggatgutgutggutgngnggngutgaggguuagngagagngagaguunguunggggnggagganggautuatunggatutggutguagngtgggutnggagut

SEQ ID NO: 123 - DNA, 300 bp, Artificial Sequence
  Description of Artificial Sequence: Synthetic oligonucleotide
  Description of Combined DNA/RNA Molecule: Synthetic oligonucleotide
  modified_base (10)..(10): c or u
  modified_base (19)..(19): c or u
  modified_base (60)..(60): c or u
  modified_base (84)..(84): c or u
  modified_base (87)..(87): c or u
  modified_base (90)..(90): c or u
  modified_base (115)..(115): c or u
  modified_base (120)..(120): c or u
  modified_base (124)..(124): c or u
  modified_base (150)..(150): c or u
  modified_base (159)..(159): c or u
  modified_base (173)..(173): c or u
  modified_base (175)..(175): c or u
  modified_base (193)..(193): c or u
  modified_base (202)..(202): c or u
  modified_base (208)..(208): c or u
  modified_base (210)..(210): c or u
  modified_base (226)..(226): c or u
  modified_base (241)..(241): c or u
  modified_base (245)..(245): c or u
  modified_base (263)..(263): c or u
  modified_base (293)..(293): c or u
aguuuutggngtutttutngggguuagagutttguututaaatggtutttgtttguagangatutgutgtguagatuatgaaungtngunguagtguuagauagaututtuatunggaunggungtuuuautgggtuuuutuaggaaagnguagaagunggggauuuuaaaungngtuuagutuutuuuauunguuuttutnggagungnguauttggtaauttgngtgtgaagaautuanggungtgttguuaggaaautgnggggaguaguutttgtggtutuauatatgngtaauat

SEQ ID NO: 124 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (37)..(37): c or u
  modified_base (55)..(55): c or u
  modified_base (59)..(59): c or u
  modified_base (74)..(74): c or u
  modified_base (90)..(90): c or u
  modified_base (92)..(92): c or u
  modified_base (98)..(98): c or u
  modified_base (107)..(107): c or u
  modified_base (125)..(125): c or u
  modified_base (127)..(127): c or u
  modified_base (141)..(141): c or u
  modified_base (150)..(150): c or u
  modified_base (176)..(176): c or u
  modified_base (180)..(180): c or u
  modified_base (185)..(185): c or u
  modified_base (210)..(210): c or u
  modified_base (213)..(213): c or u
  modified_base (216)..(216): c or u
  modified_base (240)..(240): c or u
  modified_base (281)..(281): c or u
  modified_base (290)..(290): c or u
atgttanguatatgtgagauuauaaaggutgutuuunguagtttuutgguaauanggungtgagttuttuauanguaagttauuaagtgngnggutungagaagggngggtgggaggagutggangnggtttggggtuuungguttutgngutttuutgaggggauuuagtggganggunggtunggatgaagagtutgtutgguautgnggnganggttuatgatutguauaguagatngtutguaaauaaagauuatttagagguaaagututgguuungagaaaganguuaggggut

SEQ ID NO: 125 - DNA, 300 bp, Artificial Sequence
  Description of Artificial Sequence: Synthetic oligonucleotide
  Description of Combined DNA/RNA Molecule: Synthetic oligonucleotide
  modified_base (25)..(25): c or u
  modified_base (63)..(63): c or u
  modified_base (65)..(65): c or u
  modified_base (88)..(88): c or u
  modified_base (110)..(110): c or u
  modified_base (128)..(128): c or u
  modified_base (148)..(148): c or u
  modified_base (151)..(151): c or u
  modified_base (158)..(158): c or u
  modified_base (160)..(160): c or u
  modified_base (163)..(163): c or u
  modified_base (165)..(165): c or u
  modified_base (170)..(170): c or u
  modified_base (174)..(174): c or u
  modified_base (182)..(182): c or u
  modified_base (188)..(188): c or u
  modified_base (197)..(197): c or u
  modified_base (202)..(202): c or u
  modified_base (208)..(208): c or u
  modified_base (215)..(215): c or u
  modified_base (220)..(220): c or u
  modified_base (228)..(228): c or u
  modified_base (236)..(236): c or u
  modified_base (244)..(244): c or u
  modified_base (252)..(252): c or u
  modified_base (265)..(265): c or u
  modified_base (267)..(267): c or u
  modified_base (272)..(272): c or u
  modified_base (281)..(281): c or u
  modified_base (283)..(283): c or u
  modified_base (289)..(289): c or u
  modified_base (295)..(295): c or u
  modified_base (299)..(299): c or u
guttgaauagttttttuuaatgttngatatttauattttttgtuauttttattttagtuutungngaaggaguututuaaatattuunggaguauaggutaatttagaangtgttatuutgauaaggngguuuaguuagggaggagangunggggtungngungnggggngggnguttuuunggauungggggaggnggganguaggngaaggunguuungggagagnggggtuungggagagnggggtuunggutgtgggggangngggungaggutgtngngaagungutganggung

SEQ ID NO: 126 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (5)..(5): c or u
  modified_base (11)..(11): c or u
  modified_base (17)..(17): c or u
  modified_base (19)..(19): c or u
  modified_base (28)..(28): c or u
  modified_base (33)..(33): c or u
  modified_base (35)..(35): c or u
  modified_base (48)..(48): c or u
  modified_base (56)..(56): c or u
  modified_base (64)..(64): c or u
  modified_base (72)..(72): c or u
  modified_base (80)..(80): c or u
  modified_base (85)..(85): c or u
  modified_base (92)..(92): c or u
  modified_base (98)..(98): c or u
  modified_base (103)..(103): c or u
  modified_base (112)..(112): c or u
  modified_base (118)..(118): c or u
  modified_base (126)..(126): c or u
  modified_base (130)..(130): c or u
  modified_base (135)..(135): c or u
  modified_base (137)..(137): c or u
  modified_base (140)..(140): c or u
  modified_base (142)..(142): c or u
  modified_base (149)..(149): c or u
  modified_base (152)..(152): c or u
  modified_base (172)..(172): c or u
  modified_base (190)..(190): c or u
  modified_base (212)..(212): c or u
  modified_base (235)..(235): c or u
  modified_base (237)..(237): c or u
  modified_base (275)..(275): c or u
nggungtuagngguttngngauaguutngguungngtuuuuuauagungggauuungututuungggauuungututuunggggngguuttnguutgngtuunguutuuuungggtunggggaagnguunguuungnggngnggauuunggngtutuutuuutggutgggunguuttgtuaggataauangttutaaattaguutgtgutungggaatatttgagaggutuuttngnggaggautaaaataaaagtgauaaaaaatgtaaatatngaauattggaaaaaautgttuaagu

SEQ ID NO: 127 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (17)..(17): c or u
  modified_base (19)..(19): c or u
  modified_base (53)..(53): c or u
  modified_base (76)..(76): c or u
  modified_base (84)..(84): c or u
  modified_base (90)..(90): c or u
  modified_base (102)..(102): c or u
  modified_base (116)..(116): c or u
  modified_base (127)..(127): c or u
  modified_base (132)..(132): c or u
  modified_base (140)..(140): c or u
  modified_base (150)..(150): c or u
  modified_base (168)..(168): c or u
  modified_base (172)..(172): c or u
  modified_base (175)..(175): c or u
  modified_base (182)..(182): c or u
  modified_base (184)..(184): c or u
  modified_base (202)..(202): c or u
  modified_base (204)..(204): c or u
  modified_base (224)..(224): c or u
  modified_base (234)..(234): c or u
  modified_base (245)..(245): c or u
  modified_base (257)..(257): c or u
  modified_base (263)..(263): c or u
  modified_base (266)..(266): c or u
  modified_base (289)..(289): c or u
  modified_base (292)..(292): c or u
uuttnggggauuagaungngutuuutuagatggutggggagggaguagautungggtgaaggutgggggaggtaungggatgungagtanguuagaguaggngggggatgggttungguttuutgunguutngguatutngutttguaunggguaaagaagggguuangaunggngaagagngngtggagauauagggauungngatuuagggguaggaauuunguuuuutuunggaaauutuunggguuutgagtngtguunggngutuuuuauuuuauuuuauuuungunguuuutgu

SEQ ID NO: 128 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (11)..(11): c or u
  modified_base (34)..(34): c or u
  modified_base (37)..(37): c or u
  modified_base (43)..(43): c or u
  modified_base (55)..(55): c or u
  modified_base (66)..(66): c or u
  modified_base (76)..(76): c or u
  modified_base (96)..(96): c or u
  modified_base (98)..(98): c or u
  modified_base (116)..(116): c or u
  modified_base (118)..(118): c or u
  modified_base (125)..(125): c or u
  modified_base (128)..(128): c or u
  modified_base (132)..(132): c or u
  modified_base (150)..(150): c or u
  modified_base (160)..(160): c or u
  modified_base (168)..(168): c or u
  modified_base (173)..(173): c or u
  modified_base (184)..(184): c or u
  modified_base (198)..(198): c or u
  modified_base (210)..(210): c or u
  modified_base (216)..(216): c or u
  modified_base (224)..(224): c or u
  modified_base (247)..(247): c or u
  modified_base (281)..(281): c or u
  modified_base (283)..(283): c or u
  modified_base (295)..(295): c or u
guaggggnggngggggtggggtggggtggggagngunggguangautuaggguungggaggtttungggagggggnggggttuutguuuutggatngngggtuuutgtgtutuuangngututtngunggtngtgguuuuttutttguunggtguaaagngagatgungaggngguaggaagunggaauuuatuuuunguutgututggngtautngguatuunggtauutuuuuuaguuttuauunggagtutgutuuutuuuuaguuatutgagggagngnggtutggtuuungaagg

SEQ ID NO: 129 - DNA, 300 bp, Artificial Sequence
  Description of Artificial Sequence: Synthetic oligonucleotide
  Description of Combined DNA/RNA Molecule: Synthetic oligonucleotide
  modified_base (11)..(11): c or u
  modified_base (14)..(14): c or u
  modified_base (16)..(16): c or u
  modified_base (32)..(32): c or u
  modified_base (37)..(37): c or u
  modified_base (40)..(40): c or u
  modified_base (56)..(56): c or u
  modified_base (58)..(58): c or u
  modified_base (69)..(69): c or u
  modified_base (80)..(80): c or u
  modified_base (84)..(84): c or u
  modified_base (105)..(105): c or u
  modified_base (109)..(109): c or u
  modified_base (123)..(123): c or u
  modified_base (132)..(132): c or u
  modified_base (134)..(134): c or u
  modified_base (150)..(150): c or u
  modified_base (152)..(152): c or u
  modified_base (157)..(157): c or u
  modified_base (164)..(164): c or u
  modified_base (167)..(167): c or u
  modified_base (173)..(173): c or u
  modified_base (178)..(178): c or u
  modified_base (187)..(187): c or u
  modified_base (190)..(190): c or u
  modified_base (198)..(198): c or u
  modified_base (211)..(211): c or u
  modified_base (215)..(215): c or u
  modified_base (218)..(218): c or u
  modified_base (221)..(221): c or u
  modified_base (237)..(237): c or u
  modified_base (240)..(240): c or u
  modified_base (242)..(242): c or u
  modified_base (244)..(244): c or u
  modified_base (261)..(261): c or u
  modified_base (267)..(267): c or u
  modified_base (277)..(277): c or u
  modified_base (282)..(282): c or u
  modified_base (288)..(288): c or u
  modified_base (293)..(293): c or u
ggatgggtuunggngngguuuaguuuutguungguungunggguagagautgaaungnggatuuuuaungtuutgtggangaunggauagagagagguautgaungatnguuaguaguutuunggtgggaungngtutuutguauauuungnguagnguuuuungunggagunguaunggguaagunggngagggagnggggutgattggnggungunggngguuaggggagggggngungngngggguuatgguaggutnggaggngtuutaguungagunggagungatungaguuua

SEQ ID NO: 130 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (12)..(12): c or u
  modified_base (18)..(18): c or u
  modified_base (23)..(23): c or u
  modified_base (33)..(33): c or u
  modified_base (39)..(39): c or u
  modified_base (56)..(56): c or u
  modified_base (58)..(58): c or u
  modified_base (60)..(60): c or u
  modified_base (63)..(63): c or u
  modified_base (79)..(79): c or u
  modified_base (82)..(82): c or u
  modified_base (85)..(85): c or u
  modified_base (89)..(89): c or u
  modified_base (102)..(102): c or u
  modified_base (110)..(110): c or u
  modified_base (113)..(113): c or u
  modified_base (122)..(122): c or u
  modified_base (127)..(127): c or u
  modified_base (133)..(133): c or u
  modified_base (136)..(136): c or u
  modified_base (143)..(143): c or u
  modified_base (148)..(148): c or u
  modified_base (150)..(150): c or u
  modified_base (166)..(166): c or u
  modified_base (168)..(168): c or u
  modified_base (177)..(177): c or u
  modified_base (191)..(191): c or u
  modified_base (195)..(195): c or u
  modified_base (216)..(216): c or u
  modified_base (220)..(220): c or u
  modified_base (231)..(231): c or u
  modified_base (242)..(242): c or u
  modified_base (244)..(244): c or u
  modified_base (260)..(260): c or u
  modified_base (263)..(263): c or u
  modified_base (268)..(268): c or u
  modified_base (284)..(284): c or u
  modified_base (286)..(286): c or u
  modified_base (289)..(289): c or u
tgggutnggatnggutunggutngggutagganguutungaguutguuatgguuungngnggnguuuuutuuuutggungunggnggunguuaatuaguuungutuuutngungguttguunggtgnggutunggnggggggngutgngnggggtgtguaggagangnggtuuuaungggaggutgutggngatnggtuagtguututututgtunggtngtuuauagganggtggggatungnggttuagtututguunggngggunggguaggggutgggungngungggauuuatuu

SEQ ID NO: 131 - DNA, 300 bp, Artificial Sequence
  Description of Artificial Sequence: Synthetic oligonucleotide
  Description of Combined DNA/RNA Molecule: Synthetic oligonucleotide
  modified_base (14)..(14): c or u
  modified_base (19)..(19): c or u
  modified_base (22)..(22): c or u
  modified_base (28)..(28): c or u
  modified_base (32)..(32): c or u
  modified_base (39)..(39): c or u
  modified_base (46)..(46): c or u
  modified_base (59)..(59): c or u
  modified_base (62)..(62): c or u
  modified_base (65)..(65): c or u
  modified_base (69)..(69): c or u
  modified_base (78)..(78): c or u
  modified_base (87)..(87): c or u
  modified_base (90)..(90): c or u
  modified_base (98)..(98): c or u
  modified_base (102)..(102): c or u
  modified_base (104)..(104): c or u
  modified_base (110)..(110): c or u
  modified_base (116)..(116): c or u
  modified_base (137)..(137): c or u
  modified_base (147)..(147): c or u
  modified_base (151)..(151): c or u
  modified_base (154)..(154): c or u
  modified_base (156)..(156): c or u
  modified_base (158)..(158): c or u
  modified_base (162)..(162): c or u
  modified_base (170)..(170): c or u
  modified_base (172)..(172): c or u
  modified_base (182)..(182): c or u
  modified_base (190)..(190): c or u
  modified_base (194)..(194): c or u
  modified_base (197)..(197): c or u
  modified_base (208)..(208): c or u
  modified_base (210)..(210): c or u
  modified_base (214)..(214): c or u
  modified_base (219)..(219): c or u
  modified_base (221)..(221): c or u
  modified_base (239)..(239): c or u
agaagaggaaaaungagunggnggutgnggunggguatngtatggngutagagaauttnggnggngagngggauutgnguutgggungunguutuuunguungnggtuungggaungttautttgaaaaggagtuungagguutggnguunggngngngatngggauuungngtuuagutunggggauunggunggnguuuuuuauungngagngguungngaguuaututuagguuungggaaautttuaagagggtutggggggtggggggagtaaaaaggggagggggtaggutggg

SEQ ID NO: 132 - DNA, 300 bp, Artificial Sequence
  Description of Artificial Sequence: Synthetic oligonucleotide
  Description of Combined DNA/RNA Molecule: Synthetic oligonucleotide
  modified_base (61)..(61): c or u
  modified_base (79)..(79): c or u
  modified_base (81)..(81): c or u
  modified_base (86)..(86): c or u
  modified_base (90)..(90): c or u
  modified_base (92)..(92): c or u
  modified_base (103)..(103): c or u
  modified_base (106)..(106): c or u
  modified_base (110)..(110): c or u
  modified_base (118)..(118): c or u
  modified_base (128)..(128): c or u
  modified_base (130)..(130): c or u
  modified_base (138)..(138): c or u
  modified_base (142)..(142): c or u
  modified_base (144)..(144): c or u
  modified_base (146)..(146): c or u
  modified_base (149)..(149): c or u
  modified_base (153)..(153): c or u
  modified_base (163)..(163): c or u
  modified_base (184)..(184): c or u
  modified_base (190)..(190): c or u
  modified_base (196)..(196): c or u
  modified_base (198)..(198): c or u
  modified_base (202)..(202): c or u
  modified_base (210)..(210): c or u
  modified_base (213)..(213): c or u
  modified_base (222)..(222): c or u
  modified_base (231)..(231): c or u
  modified_base (235)..(235): c or u
  modified_base (238)..(238): c or u
  modified_base (241)..(241): c or u
  modified_base (254)..(254): c or u
  modified_base (261)..(261): c or u
  modified_base (268)..(268): c or u
  modified_base (272)..(272): c or u
  modified_base (278)..(278): c or u
  modified_base (281)..(281): c or u
  modified_base (286)..(286): c or u
uuuaguutauuuuutuuuutttttautuuuuuuauuuuuuagauuututtgaaagtttuungggguutgagagtggutngngggungutngngggtggggggngunggungggtuuunggagutggangnggggtuungatngngngungggnguuagguutngggautuuttttuaaagtaanggtuungggaungngggnggggaggnggngguuuaggnguaggtuungutngungungaagttututagnguuatangatguunggunguagungunggutnggttttuututtut

SEQ ID NO: 133 - DNA, 300 bp, Artificial Sequence
  Description of Artificial Sequence: Synthetic oligonucleotide
  Description of Combined DNA/RNA Molecule: Synthetic oligonucleotide
  modified_base (38)..(38): c or u
  modified_base (40)..(40): c or u
  modified_base (43)..(43): c or u
  modified_base (84)..(84): c or u
  modified_base (93)..(93): c or u
  modified_base (96)..(96): c or u
  modified_base (98)..(98): c or u
  modified_base (103)..(103): c or u
  modified_base (112)..(112): c or u
  modified_base (114)..(114): c or u
  modified_base (122)..(122): c or u
  modified_base (128)..(128): c or u
  modified_base (136)..(136): c or u
  modified_base (138)..(138): c or u
  modified_base (145)..(145): c or u
  modified_base (147)..(147): c or u
  modified_base (150)..(150): c or u
  modified_base (155)..(155): c or u
  modified_base (160)..(160): c or u
  modified_base (166)..(166): c or u
  modified_base (168)..(168): c or u
  modified_base (176)..(176): c or u
  modified_base (184)..(184): c or u
  modified_base (192)..(192): c or u
  modified_base (195)..(195): c or u
  modified_base (203)..(203): c or u
  modified_base (210)..(210): c or u
  modified_base (212)..(212): c or u
  modified_base (219)..(219): c or u
  modified_base (229)..(229): c or u
  modified_base (241)..(241): c or u
  modified_base (264)..(264): c or u
  modified_base (279)..(279): c or u
ttutuuutgaaauttgtttgaaaauuuaagtgaaaaungngangatutguauautuaaaaguaagtguuaagtaagtguuutgnggtgguutnggngnguuunggggtgagngnguaaagungggagngaggtgungngagutgngngunguuungggungguutngngtgtgggnggutgggnggutgggnggngggaggangguutungngggutungggautguunggutggutgutnguauaautttttttttttuuuungtutgutgauttttnggguuaggtgaagtgtttggg

SEQ ID NO: 134 - DNA, 300 bp, Artificial Sequence
  Description of Artificial Sequence: Synthetic oligonucleotide
  Description of Combined DNA/RNA Molecule: Synthetic oligonucleotide
  modified_base (21)..(21): c or u
  modified_base (36)..(36): c or u
  modified_base (59)..(59): c or u
  modified_base (71)..(71): c or u
  modified_base (81)..(81): c or u
  modified_base (88)..(88): c or u
  modified_base (90)..(90): c or u
  modified_base (97)..(97): c or u
  modified_base (105)..(105): c or u
  modified_base (108)..(108): c or u
  modified_base (116)..(116): c or u
  modified_base (124)..(124): c or u
  modified_base (132)..(132): c or u
  modified_base (134)..(134): c or u
  modified_base (140)..(140): c or u
  modified_base (145)..(145): c or u
  modified_base (150)..(150): c or u
  modified_base (153)..(153): c or u
  modified_base (155)..(155): c or u
  modified_base (162)..(162): c or u
  modified_base (164)..(164): c or u
  modified_base (172)..(172): c or u
  modified_base (178)..(178): c or u
  modified_base (186)..(186): c or u
  modified_base (188)..(188): c or u
  modified_base (197)..(197): c or u
  modified_base (202)..(202): c or u
  modified_base (204)..(204): c or u
  modified_base (207)..(207): c or u
  modified_base (216)..(216): c or u
  modified_base (257)..(257): c or u
  modified_base (260)..(260): c or u
  modified_base (262)..(262): c or u
uuuaaauauttuauutgguungaaaagtuaguagangggggaaaaaaaaaaagttgtgngaguaguuagunggguagtuunggaguungnggaggungtuutuungunguuuagunguuuagunguuuauangngaggungguunggggnggngnguagutngngguauutngutuunggutttgngngutuauuunggggngngungagguuaunguaggguauttauttgguauttguttttgagtgtguagatngtngnggttttuauttgggttttuaaauaagtttuagggagaa

SEQ ID NO: 135 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (14)..(14): c or u
  modified_base (16)..(16): c or u
  modified_base (26)..(26): c or u
  modified_base (28)..(28): c or u
  modified_base (30)..(30): c or u
  modified_base (34)..(34): c or u
  modified_base (40)..(40): c or u
  modified_base (57)..(57): c or u
  modified_base (64)..(64): c or u
  modified_base (76)..(76): c or u
  modified_base (82)..(82): c or u
  modified_base (84)..(84): c or u
  modified_base (87)..(87): c or u
  modified_base (106)..(106): c or u
  modified_base (110)..(110): c or u
  modified_base (116)..(116): c or u
  modified_base (126)..(126): c or u
  modified_base (129)..(129): c or u
  modified_base (136)..(136): c or u
  modified_base (141)..(141): c or u
  modified_base (143)..(143): c or u
  modified_base (150)..(150): c or u
  modified_base (160)..(160): c or u
  modified_base (163)..(163): c or u
  modified_base (169)..(169): c or u
  modified_base (171)..(171): c or u
  modified_base (176)..(176): c or u
  modified_base (184)..(184): c or u
  modified_base (188)..(188): c or u
  modified_base (197)..(197): c or u
  modified_base (203)..(203): c or u
  modified_base (212)..(212): c or u
  modified_base (219)..(219): c or u
  modified_base (226)..(226): c or u
  modified_base (244)..(244): c or u
  modified_base (253)..(253): c or u
  modified_base (265)..(265): c or u
  modified_base (267)..(267): c or u
  modified_base (270)..(270): c or u
  modified_base (280)..(280): c or u
  modified_base (285)..(285): c or u
  modified_base (295)..(295): c or u
attungggagatungnguuuagguungngngutnggggungututgguutuagagungutguungauuuaggaaungguaungngtnguuaaggguagtuattggnggunguaganggaggagganggngttggungggangnggauagnguaggguagnggngggggngngggungggguuangggnguaggggunggagungutguagunguaagungttguangtggauttuaaggagutnggutgggangautggatuatngngungutggautangaggngtauuautgngaggg

SEQ ID NO: 136 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (15)..(15): c or u
  modified_base (20)..(20): c or u
  modified_base (30)..(30): c or u
  modified_base (33)..(33): c or u
  modified_base (35)..(35): c or u
  modified_base (47)..(47): c or u
  modified_base (56)..(56): c or u
  modified_base (74)..(74): c or u
  modified_base (81)..(81): c or u
  modified_base (88)..(88): c or u
  modified_base (97)..(97): c or u
  modified_base (103)..(103): c or u
  modified_base (112)..(112): c or u
  modified_base (116)..(116): c or u
  modified_base (124)..(124): c or u
  modified_base (129)..(129): c or u
  modified_base (131)..(131): c or u
  modified_base (137)..(137): c or u
  modified_base (140)..(140): c or u
  modified_base (150)..(150): c or u
  modified_base (157)..(157): c or u
  modified_base (159)..(159): c or u
  modified_base (164)..(164): c or u
  modified_base (171)..(171): c or u
  modified_base (174)..(174): c or u
  modified_base (184)..(184): c or u
  modified_base (190)..(190): c or u
  modified_base (194)..(194): c or u
  modified_base (213)..(213): c or u
  modified_base (216)..(216): c or u
  modified_base (218)..(218): c or u
  modified_base (224)..(224): c or u
  modified_base (236)..(236): c or u
  modified_base (243)..(243): c or u
  modified_base (260)..(260): c or u
  modified_base (266)..(266): c or u
  modified_base (270)..(270): c or u
  modified_base (272)..(272): c or u
  modified_base (274)..(274): c or u
  modified_base (284)..(284): c or u
  modified_base (286)..(286): c or u
  modified_base (295)..(295): c or u
uuutnguagtggtanguutngtagtuuagnggngngatgatuuagtngtuuuagungagutuuttgaagtuuangtguaangguttgnggutguagnggutungguuuutgnguungtgguuungguungnguuuungungutguuutgngutgtungngtuungguuaangungtuutuutungtutgnggunguuaatgautguuuttggngangnggtgunggttuutgggtnggguagnggututgagguuagagngguuungagngngnggguutgggngnggatutuunggaat

SEQ ID NO: 137 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (28)..(28): c or u
  modified_base (38)..(38): c or u
  modified_base (44)..(44): c or u
  modified_base (46)..(46): c or u
  modified_base (62)..(62): c or u
  modified_base (70)..(70): c or u
  modified_base (80)..(80): c or u
  modified_base (95)..(95): c or u
  modified_base (100)..(100): c or u
  modified_base (108)..(108): c or u
  modified_base (110)..(110): c or u
  modified_base (119)..(119): c or u
  modified_base (126)..(126): c or u
  modified_base (132)..(132): c or u
  modified_base (141)..(141): c or u
  modified_base (146)..(146): c or u
  modified_base (150)..(150): c or u
  modified_base (157)..(157): c or u
  modified_base (161)..(161): c or u
  modified_base (172)..(172): c or u
  modified_base (174)..(174): c or u
  modified_base (178)..(178): c or u
  modified_base (182)..(182): c or u
  modified_base (199)..(199): c or u
  modified_base (206)..(206): c or u
  modified_base (213)..(213): c or u
  modified_base (219)..(219): c or u
  modified_base (221)..(221): c or u
  modified_base (225)..(225): c or u
  modified_base (231)..(231): c or u
  modified_base (237)..(237): c or u
  modified_base (239)..(239): c or u
  modified_base (249)..(249): c or u
  modified_base (251)..(251): c or u
  modified_base (255)..(255): c or u
  modified_base (258)..(258): c or u
  modified_base (279)..(279): c or u
  modified_base (293)..(293): c or u
ggggunguagggggutggaaggaagtgnguagtgtggngagagngngaauaaaguuututunggaguuungtuauuuutnggtgauuuuagguunguuungutgagungnggggutuunggguutnguutungaguaggunguaunguunggtgggnguangtuagguutungnggunguunggguuagtgutuuuutnggtuuunguaggungaguungnggungguuungaaggngngagggauagngnggunggnggtggaguutuautuagguanggaguuuauagagngaggutg

SEQ ID NO: 138 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (21)..(21): c or u
  modified_base (42)..(42): c or u
  modified_base (45)..(45): c or u
  modified_base (49)..(49): c or u
  modified_base (51)..(51): c or u
  modified_base (61)..(61): c or u
  modified_base (63)..(63): c or u
  modified_base (69)..(69): c or u
  modified_base (75)..(75): c or u
  modified_base (79)..(79): c or u
  modified_base (81)..(81): c or u
  modified_base (87)..(87): c or u
  modified_base (94)..(94): c or u
  modified_base (101)..(101): c or u
  modified_base (118)..(118): c or u
  modified_base (122)..(122): c or u
  modified_base (126)..(126): c or u
  modified_base (128)..(128): c or u
  modified_base (139)..(139): c or u
  modified_base (143)..(143): c or u
  modified_base (150)..(150): c or u
  modified_base (154)..(154): c or u
  modified_base (159)..(159): c or u
  modified_base (168)..(168): c or u
  modified_base (174)..(174): c or u
  modified_base (181)..(181): c or u
  modified_base (190)..(190): c or u
  modified_base (192)..(192): c or u
  modified_base (200)..(200): c or u
  modified_base (205)..(205): c or u
  modified_base (220)..(220): c or u
  modified_base (230)..(230): c or u
  modified_base (238)..(238): c or u
  modified_base (254)..(254): c or u
  modified_base (256)..(256): c or u
  modified_base (262)..(262): c or u
  modified_base (272)..(272): c or u
  modified_base (294)..(294): c or u
uaguutngututgtgggutungtguutgagtgaggutuuaungunggungngutgtuuutngnguuttnggggunggungngggutngguutgnggggaungaggggaguautgguungggnggungnggagguutgangtgnguuuaungggnggtgngguutgutnggaggngagguungggaguuungnggutuagnggggnggguutggggtuaungaggggtganggggutunggagagggutttgttngngututnguuauautgnguauttuuttuuaguuuuutgngguuuu

SEQ ID NO: 139 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (11)..(11): c or u
  modified_base (35)..(35): c or u
  modified_base (38)..(38): c or u
  modified_base (45)..(45): c or u
  modified_base (47)..(47): c or u
  modified_base (72)..(72): c or u
  modified_base (99)..(99): c or u
  modified_base (105)..(105): c or u
  modified_base (110)..(110): c or u
  modified_base (122)..(122): c or u
  modified_base (125)..(125): c or u
  modified_base (129)..(129): c or u
  modified_base (133)..(133): c or u
  modified_base (137)..(137): c or u
  modified_base (140)..(140): c or u
  modified_base (147)..(147): c or u
  modified_base (150)..(150): c or u
  modified_base (156)..(156): c or u
  modified_base (161)..(161): c or u
  modified_base (169)..(169): c or u
  modified_base (171)..(171): c or u
  modified_base (173)..(173): c or u
  modified_base (183)..(183): c or u
  modified_base (204)..(204): c or u
  modified_base (208)..(208): c or u
  modified_base (210)..(210): c or u
  modified_base (219)..(219): c or u
  modified_base (238)..(238): c or u
  modified_base (241)..(241): c or u
  modified_base (259)..(259): c or u
  modified_base (263)..(263): c or u
  modified_base (278)..(278): c or u
  modified_base (283)..(283): c or u
  modified_base (293)..(293): c or u
ungutguuuunggauuutututguutguauaautngtngututtngngutguagaauutguaguuutgggungaggauaauaaagtgguttuagtgtungggutnguutnggtggtgtgagnganguungtungatnggngtggagngunggguunggagnggtggagngngnggutguutgngtuuatggtutagtgguagungggngngtgaggagngguagguuttgaggutgtngtngagggutuutuuauuaunggunggutuuuaaguuagngttgnguagatguangguuagu

SEQ ID NO: 140 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (17)..(17): c or u
  modified_base (22)..(22): c or u
  modified_base (37)..(37): c or u
  modified_base (41)..(41): c or u
  modified_base (59)..(59): c or u
  modified_base (62)..(62): c or u
  modified_base (81)..(81): c or u
  modified_base (90)..(90): c or u
  modified_base (92)..(92): c or u
  modified_base (96)..(96): c or u
  modified_base (117)..(117): c or u
  modified_base (127)..(127): c or u
  modified_base (129)..(129): c or u
  modified_base (131)..(131): c or u
  modified_base (139)..(139): c or u
  modified_base (144)..(144): c or u
  modified_base (150)..(150): c or u
  modified_base (153)..(153): c or u
  modified_base (160)..(160): c or u
  modified_base (163)..(163): c or u
  modified_base (167)..(167): c or u
  modified_base (171)..(171): c or u
  modified_base (175)..(175): c or u
  modified_base (178)..(178): c or u
  modified_base (190)..(190): c or u
  modified_base (195)..(195): c or u
  modified_base (201)..(201): c or u
  modified_base (228)..(228): c or u
  modified_base (253)..(253): c or u
  modified_base (255)..(255): c or u
  modified_base (262)..(262): c or u
  modified_base (265)..(265): c or u
  modified_base (289)..(289): c or u
  modified_base (298)..(298): c or u
gutggungtguatutgnguaangutgguttgggagunggunggtggtggaggaguuutngangauaguutuaagguutgungutuutuangnguunggutguuautagauuatgganguagguagungngngutuuaungutunggguunggngutuuangungatnggangggngtngutuauauuaungaggngaguunggauautgaaguuautttgttgtuutngguuuagggutguaggttutguagngngaagagngangagttgtguagguagagagggtunggggguagngg

SEQ ID NO: 141 - DNA, 300 bp, Artificial Sequence
  Description of Artificial Sequence: Synthetic oligonucleotide
  Description of Combined DNA/RNA Molecule: Synthetic oligonucleotide
  modified_base (26)..(26): c or u
  modified_base (34)..(34): c or u
  modified_base (48)..(48): c or u
  modified_base (75)..(75): c or u
  modified_base (81)..(81): c or u
  modified_base (88)..(88): c or u
  modified_base (90)..(90): c or u
  modified_base (109)..(109): c or u
  modified_base (125)..(125): c or u
  modified_base (130)..(130): c or u
  modified_base (133)..(133): c or u
  modified_base (135)..(135): c or u
  modified_base (137)..(137): c or u
  modified_base (140)..(140): c or u
  modified_base (143)..(143): c or u
  modified_base (150)..(150): c or u
  modified_base (152)..(152): c or u
  modified_base (164)..(164): c or u
  modified_base (178)..(178): c or u
  modified_base (181)..(181): c or u
  modified_base (189)..(189): c or u
  modified_base (197)..(197): c or u
  modified_base (201)..(201): c or u
  modified_base (212)..(212): c or u
  modified_base (215)..(215): c or u
  modified_base (217)..(217): c or u
  modified_base (232)..(232): c or u
  modified_base (236)..(236): c or u
  modified_base (242)..(242): c or u
  modified_base (244)..(244): c or u
  modified_base (271)..(271): c or u
  modified_base (298)..(298): c or u
auuattgtuatagtaauauauaattnggguuuangtagauttaatuungagagguaattgttuuuttguttgggnggutangutuuungnggggutguutguaguuuunggguuuttguagutunggganggngngnggnggnggaggungngggguuuuaagnguuaguutgguuunggnguagatgngutguuunggunguaguuuagungungngtgtgttgtuaggangatnggaaangngtgtgtggggagatgggtguuagtgtnguuttgtuuattatuuaaaauuuagtngu

SEQ ID NO: 142 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (29)..(29): c or u
  modified_base (56)..(56): c or u
  modified_base (58)..(58): c or u
  modified_base (64)..(64): c or u
  modified_base (68)..(68): c or u
  modified_base (83)..(83): c or u
  modified_base (85)..(85): c or u
  modified_base (88)..(88): c or u
  modified_base (99)..(99): c or u
  modified_base (103)..(103): c or u
  modified_base (111)..(111): c or u
  modified_base (119)..(119): c or u
  modified_base (122)..(122): c or u
  modified_base (136)..(136): c or u
  modified_base (148)..(148): c or u
  modified_base (150)..(150): c or u
  modified_base (157)..(157): c or u
  modified_base (160)..(160): c or u
  modified_base (163)..(163): c or u
  modified_base (165)..(165): c or u
  modified_base (167)..(167): c or u
  modified_base (170)..(170): c or u
  modified_base (175)..(175): c or u
  modified_base (191)..(191): c or u
  modified_base (210)..(210): c or u
  modified_base (212)..(212): c or u
  modified_base (219)..(219): c or u
  modified_base (225)..(225): c or u
  modified_base (252)..(252): c or u
  modified_base (266)..(266): c or u
  modified_base (274)..(274): c or u
gngautgggttttggataatggauaaggngauautgguauuuatutuuuuauauangngtttungatngtuutgauaauauangnggnggutgggutgnggungggguagnguatutgngungggguuaggutggnguttgggguuungngguutungungungngngungtuunggagutguaaggguungggggutguagguaguuungnggggagngtagunguuuaaguaagggaauaattguututngggattaagtutangtggguungaattgtgtgttautatgauaatggt

SEQ ID NO: 143 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (3)..(3): c or u
  modified_base (7)..(7): c or u
  modified_base (50)..(50): c or u
  modified_base (52)..(52): c or u
  modified_base (70)..(70): c or u
  modified_base (113)..(113): c or u
  modified_base (151)..(151): c or u
  modified_base (171)..(171): c or u
  modified_base (224)..(224): c or u
  modified_base (274)..(274): c or u
ngngtunguutuuutggauuatttuautuuttuaagtuautggutuuaungngttttutgttuuuauuungtuauaautttgggguttaaagguauuaggatutgguatuuungggatguuauutgtuttuuaggatgtgtuutggutuungatguuuuaagutaaguuunggauaggutgggaauututuuutaguaguuuutguuutggtuuutaggguuunguagguuttggggtgguagtgguuttgtuuuatgtuatuuuagagguutngggagguagatggttttgtutaggaa

SEQ ID NO: 144 - DNA, 300 bp, Artificial Sequence
  Description of Artificial Sequence: Synthetic oligonucleotide
  Description of Combined DNA/RNA Molecule: Synthetic oligonucleotide
  modified_base (26)..(26): c or u
  modified_base (76)..(76): c or u
  modified_base (129)..(129): c or u
  modified_base (149)..(149): c or u
  modified_base (187)..(187): c or u
  modified_base (230)..(230): c or u
  modified_base (248)..(248): c or u
  modified_base (250)..(250): c or u
  modified_base (293)..(293): c or u
  modified_base (297)..(297): c or u
  modified_base (299)..(299): c or u
ttuutagauaaaauuatutguutuungagguututgggatgauatgggauaagguuautguuauuuuaagguutgngggguuutagggauuaggguaggggutgutagggagaggttuuuaguutgtungggguttaguttgggguatngggaguuaggauauatuutggaagauaggtgguatuunggggatguuagatuutggtguutttaaguuuuaaagttgtganggggtgggaauagaaaangnggtggaguuagtgauttgaaggagtgaaatggtuuagggaggnggangng

SEQ ID NO: 145 - DNA, 300 bp, Artificial Sequence
  Description of Artificial Sequence: Synthetic oligonucleotide
  Description of Combined DNA/RNA Molecule: Synthetic oligonucleotide
  modified_base (18)..(18): c or u
  modified_base (44)..(44): c or u
  modified_base (52)..(52): c or u
  modified_base (54)..(54): c or u
  modified_base (58)..(58): c or u
  modified_base (69)..(69): c or u
  modified_base (75)..(75): c or u
  modified_base (79)..(79): c or u
  modified_base (97)..(97): c or u
  modified_base (105)..(105): c or u
  modified_base (107)..(107): c or u
  modified_base (109)..(109): c or u
  modified_base (114)..(114): c or u
  modified_base (122)..(122): c or u
  modified_base (127)..(127): c or u
  modified_base (141)..(141): c or u
  modified_base (146)..(146): c or u
  modified_base (150)..(150): c or u
  modified_base (153)..(153): c or u
  modified_base (160)..(160): c or u
  modified_base (168)..(168): c or u
  modified_base (177)..(177): c or u
  modified_base (179)..(179): c or u
  modified_base (182)..(182): c or u
  modified_base (195)..(195): c or u
  modified_base (201)..(201): c or u
  modified_base (226)..(226): c or u
  modified_base (231)..(231): c or u
  modified_base (238)..(238): c or u
  modified_base (245)..(245): c or u
  modified_base (264)..(264): c or u
  modified_base (275)..(275): c or u
utttutttgttatutuungtgaaauuttuauttaguaggtgganggaguuungngaunggguagagtungggutnguungaggauaggaggaggagngggaguungngngtuungggagagnguuungagtguaggtuuunguuunguunggngaguuungutggagngaguuuagngngunggggutggggggngguuangauuuuuuutgaagggggtgguuanggagnguauuungagaagngaguuuuuutuuuuagagngutgutuutgnggutgutgutgutgutggtgauuaa

SEQ ID NO: 146 - DNA, 300 bp, Artificial Sequence
  Description of Artificial Sequence: Synthetic oligonucleotide
  Description of Combined DNA/RNA Molecule: Synthetic oligonucleotide
  modified_base (25)..(25): c or u
  modified_base (36)..(36): c or u
  modified_base (55)..(55): c or u
  modified_base (62)..(62): c or u
  modified_base (69)..(69): c or u
  modified_base (74)..(74): c or u
  modified_base (99)..(99): c or u
  modified_base (105)..(105): c or u
  modified_base (118)..(118): c or u
  modified_base (121)..(121): c or u
  modified_base (123)..(123): c or u
  modified_base (132)..(132): c or u
  modified_base (140)..(140): c or u
  modified_base (147)..(147): c or u
  modified_base (150)..(150): c or u
  modified_base (154)..(154): c or u
  modified_base (159)..(159): c or u
  modified_base (173)..(173): c or u
  modified_base (178)..(178): c or u
  modified_base (186)..(186): c or u
  modified_base (191)..(191): c or u
  modified_base (193)..(193): c or u
  modified_base (195)..(195): c or u
  modified_base (203)..(203): c or u
  modified_base (221)..(221): c or u
  modified_base (225)..(225): c or u
  modified_base (231)..(231): c or u
  modified_base (242)..(242): c or u
  modified_base (246)..(246): c or u
  modified_base (248)..(248): c or u
  modified_base (256)..(256): c or u
  modified_base (282)..(282): c or u
ttggtuauuaguaguaguaguagunguaggaguagngututggggaggggggutnguttutnggggtgngutungtgguuauuuuuttuagggggggtngtggunguuuuuuaguuunggngngutgggutngutuuagnggggutngungggnggggnggggauutguautnggggngututuungggangngngggutuungutuutuutuutgtuutngggngaguunggaututguunggtngnggggutungtuuauutgutaagtgaaggtttuangggagataauaaagaaag

SEQ ID NO: 147 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (8)..(8): c or u
  modified_base (13)..(13): c or u
  modified_base (16)..(16): c or u
  modified_base (19)..(19): c or u
  modified_base (25)..(25): c or u
  modified_base (29)..(29): c or u
  modified_base (31)..(31): c or u
  modified_base (43)..(43): c or u
  modified_base (55)..(55): c or u
  modified_base (67)..(67): c or u
  modified_base (76)..(76): c or u
  modified_base (82)..(82): c or u
  modified_base (85)..(85): c or u
  modified_base (101)..(101): c or u
  modified_base (108)..(108): c or u
  modified_base (110)..(110): c or u
  modified_base (124)..(124): c or u
  modified_base (144)..(144): c or u
  modified_base (146)..(146): c or u
  modified_base (151)..(151): c or u
  modified_base (155)..(155): c or u
  modified_base (162)..(162): c or u
  modified_base (182)..(182): c or u
  modified_base (184)..(184): c or u
  modified_base (208)..(208): c or u
  modified_base (213)..(213): c or u
  modified_base (244)..(244): c or u
  modified_base (253)..(253): c or u
  modified_base (272)..(272): c or u
  modified_base (276)..(276): c or u
  modified_base (281)..(281): c or u
  modified_base (288)..(288): c or u
  modified_base (291)..(291): c or u
guuagngngggungunggngatganggungngaaguaggagunguaguuuauuunggggguuagggngaguuaggnguagunggnggauuaggtgagagtngguagungngguuagguuutuungggaggggtggutuuagtgngngutunguunguutuunguttuuuaggutgggutuungnguutuuututtutuauuutuuuunguuunguuuuagttuuaggututuutguttutuuanggaututgngggaagttagaguututgngtgngutungggguunggngagaggatg

SEQ ID NO: 148 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (12)..(12): c or u
  modified_base (19)..(19): c or u
  modified_base (24)..(24): c or u
  modified_base (28)..(28): c or u
  modified_base (47)..(47): c or u
  modified_base (56)..(56): c or u
  modified_base (87)..(87): c or u
  modified_base (92)..(92): c or u
  modified_base (116)..(116): c or u
  modified_base (118)..(118): c or u
  modified_base (138)..(138): c or u
  modified_base (145)..(145): c or u
  modified_base (149)..(149): c or u
  modified_base (154)..(154): c or u
  modified_base (156)..(156): c or u
  modified_base (176)..(176): c or u
  modified_base (190)..(190): c or u
  modified_base (192)..(192): c or u
  modified_base (199)..(199): c or u
  modified_base (215)..(215): c or u
  modified_base (218)..(218): c or u
  modified_base (224)..(224): c or u
  modified_base (233)..(233): c or u
  modified_base (245)..(245): c or u
  modified_base (257)..(257): c or u
  modified_base (269)..(269): c or u
  modified_base (271)..(271): c or u
  modified_base (275)..(275): c or u
  modified_base (281)..(281): c or u
  modified_base (284)..(284): c or u
  modified_base (287)..(287): c or u
  modified_base (292)..(292): c or u
  modified_base (294)..(294): c or u
uatuututngunggguuunggagnguanguagaggututaauttuunguagagtungtggagaaguaggagaguutggaautggggnggggngggggagggtgagaagagggaggngngggaguuuaguutgggaagngggaggngggnggagngnguautggaguuauuuutuungggaggguutggungnggutgungaututuauutggtungunggutgnguutggutnguuutgguuuunggggtgggutgnggutuutguttngnggungtuatngunggngguungngutggu

SEQ ID NO: 149 - DNA, 300 bp, Artificial Sequence
  Description of Artificial Sequence: Synthetic oligonucleotide
  Description of Combined DNA/RNA Molecule: Synthetic oligonucleotide
  modified_base (15)..(15): c or u
  modified_base (25)..(25): c or u
  modified_base (28)..(28): c or u
  modified_base (32)..(32): c or u
  modified_base (40)..(40): c or u
  modified_base (55)..(55): c or u
  modified_base (59)..(59): c or u
  modified_base (96)..(96): c or u
  modified_base (100)..(100): c or u
  modified_base (118)..(118): c or u
  modified_base (127)..(127): c or u
  modified_base (131)..(131): c or u
  modified_base (138)..(138): c or u
  modified_base (144)..(144): c or u
  modified_base (151)..(151): c or u
  modified_base (165)..(165): c or u
  modified_base (170)..(170): c or u
  modified_base (174)..(174): c or u
  modified_base (186)..(186): c or u
  modified_base (191)..(191): c or u
  modified_base (199)..(199): c or u
  modified_base (214)..(214): c or u
  modified_base (218)..(218): c or u
  modified_base (257)..(257): c or u
ggutgaaggtguuunggggaauuunggngggngguuuaungagggagggagaggnggungggauuaaggaatgggguututtggttuuuuattaanguangutgaagaaatutgutgngutuutganggungutuaungggttngaguuungtuutuutatagunggggngutngutgguuaaagngauungaguaggngaatgauutttaggngganggggttttuuututgutttuttgtttuttttgaggagangggtgtgtgtttgtgaggtggggatgggggaagagtgtuuuag

SEQ ID NO: 150 - DNA, 300 bp, Artificial Sequence
  Description of Artificial Sequence: Synthetic oligonucleotide
  Description of Combined DNA/RNA Molecule: Synthetic oligonucleotide
  modified_base (43)..(43): c or u
  modified_base (82)..(82): c or u
  modified_base (86)..(86): c or u
  modified_base (101)..(101): c or u
  modified_base (109)..(109): c or u
  modified_base (114)..(114): c or u
  modified_base (126)..(126): c or u
  modified_base (130)..(130): c or u
  modified_base (135)..(135): c or u
  modified_base (149)..(149): c or u
  modified_base (156)..(156): c or u
  modified_base (162)..(162): c or u
  modified_base (169)..(169): c or u
  modified_base (173)..(173): c or u
  modified_base (182)..(182): c or u
  modified_base (200)..(200): c or u
  modified_base (204)..(204): c or u
  modified_base (241)..(241): c or u
  modified_base (245)..(245): c or u
  modified_base (260)..(260): c or u
  modified_base (268)..(268): c or u
  modified_base (272)..(272): c or u
  modified_base (275)..(275): c or u
  modified_base (285)..(285): c or u
utgggauaututtuuuuuatuuuuauutuauaaauauauauungtutuutuaaaagaaauaagaaaguagagggaaaauuungtunguutaaaggtuattnguutgutngggtngutttgguuagngagnguuunggutataggagganggggutngaauunggtgagnggungtuaggagnguaguagatttuttuagngtgngttaatggggaauuaagagguuuuattuuttggtuunggunguututuuutuuutnggtgggunguungunggggttuuungggguauuttuaguu

SEQ ID NO: 151 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (44)..(44): c or u
  modified_base (58)..(58): c or u
  modified_base (64)..(64): c or u
  modified_base (78)..(78): c or u
  modified_base (83)..(83): c or u
  modified_base (88)..(88): c or u
  modified_base (90)..(90): c or u
  modified_base (93)..(93): c or u
  modified_base (98)..(98): c or u
  modified_base (101)..(101): c or u
  modified_base (109)..(109): c or u
  modified_base (117)..(117): c or u
  modified_base (128)..(128): c or u
  modified_base (148)..(148): c or u
  modified_base (151)..(151): c or u
  modified_base (156)..(156): c or u
  modified_base (200)..(200): c or u
  modified_base (204)..(204): c or u
  modified_base (207)..(207): c or u
  modified_base (211)..(211): c or u
  modified_base (220)..(220): c or u
  modified_base (225)..(225): c or u
  modified_base (230)..(230): c or u
  modified_base (232)..(232): c or u
  modified_base (242)..(242): c or u
  modified_base (254)..(254): c or u
  modified_base (259)..(259): c or u
  modified_base (264)..(264): c or u
  modified_base (267)..(267): c or u
  modified_base (271)..(271): c or u
  modified_base (293)..(293): c or u
  modified_base (299)..(299): c or u
gngagttgtaaauutuagagaaagguauttgtuuuuaguaaaanguttggagaggaungtguangutgtgutguuuunguuungagangngungggungungggtuaunggttttungaaagggauungguagagauaaagtguuttngungutgngataggttggttttautttguaataaauaguuuutaatgggaungggngungggnggagagutngguunggggngngguutttgunguutggututgngggunguuungungggnguuaggttttggggggtgguungguuung

SEQ ID NO: 152 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (7)..(7): c or u
  modified_base (29)..(29): c or u
  modified_base (33)..(33): c or u
  modified_base (36)..(36): c or u
  modified_base (41)..(41): c or u
  modified_base (46)..(46): c or u
  modified_base (58)..(58): c or u
  modified_base (68)..(68): c or u
  modified_base (70)..(70): c or u
  modified_base (75)..(75): c or u
  modified_base (80)..(80): c or u
  modified_base (89)..(89): c or u
  modified_base (93)..(93): c or u
  modified_base (96)..(96): c or u
  modified_base (100)..(100): c or u
  modified_base (144)..(144): c or u
  modified_base (149)..(149): c or u
  modified_base (152)..(152): c or u
  modified_base (172)..(172): c or u
  modified_base (183)..(183): c or u
  modified_base (191)..(191): c or u
  modified_base (199)..(199): c or u
  modified_base (202)..(202): c or u
  modified_base (207)..(207): c or u
  modified_base (210)..(210): c or u
  modified_base (212)..(212): c or u
  modified_base (217)..(217): c or u
  modified_base (222)..(222): c or u
  modified_base (236)..(236): c or u
  modified_base (242)..(242): c or u
  modified_base (256)..(256): c or u
  modified_base (298)..(298): c or u
nggggunggguuauuuuuuaaaauutggnguunggnggggngguunguagaguuaggngguaaaggungnguuungggungagututunguunggnguunggtuuuattaggggutgtttattguaaagtaaaauuaauutatnguagnggngaagguautttgtututgungggtuuutttnggaaaaunggtgauunggngguunggngngtutnggggnggggguaguauagngtguanggtuututuuaagngttttgutggggauaagtguutttututgaggtttauaautngu

SEQ ID NO: 153 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (11)..(11): c or u
  modified_base (14)..(14): c or u
  modified_base (16)..(16): c or u
  modified_base (22)..(22): c or u
  modified_base (29)..(29): c or u
  modified_base (33)..(33): c or u
  modified_base (36)..(36): c or u
  modified_base (40)..(40): c or u
  modified_base (54)..(54): c or u
  modified_base (57)..(57): c or u
  modified_base (65)..(65): c or u
  modified_base (70)..(70): c or u
  modified_base (75)..(75): c or u
  modified_base (78)..(78): c or u
  modified_base (87)..(87): c or u
  modified_base (105)..(105): c or u
  modified_base (108)..(108): c or u
  modified_base (136)..(136): c or u
  modified_base (139)..(139): c or u
  modified_base (148)..(148): c or u
  modified_base (151)..(151): c or u
  modified_base (154)..(154): c or u
  modified_base (157)..(157): c or u
  modified_base (163)..(163): c or u
  modified_base (180)..(180): c or u
  modified_base (189)..(189): c or u
  modified_base (204)..(204): c or u
  modified_base (206)..(206): c or u
  modified_base (208)..(208): c or u
  modified_base (217)..(217): c or u
  modified_base (219)..(219): c or u
  modified_base (240)..(240): c or u
  modified_base (250)..(250): c or u
  modified_base (254)..(254): c or u
  modified_base (264)..(264): c or u
  modified_base (270)..(270): c or u
  modified_base (277)..(277): c or u
  modified_base (298)..(298): c or u
ttgnggagtungungngguutnggutuunguunggnguungguutgguuuuaungungutuautnggtunguatngunguuauutunggagutggtggggaguunggngagggaggguutggaagggguuutgggngungagtuuuungunggngungauaunguutguuaggaguagungguutgutngaggtgautguagungngnggttutggngngguttuttuauuaauatgagngggtututgngtungagagtgagnguagunggguagnguutagtggattauaguagangu

SEQ ID NO: 154 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (23)..(23): c or u
  modified_base (30)..(30): c or u
  modified_base (36)..(36): c or u
  modified_base (46)..(46): c or u
  modified_base (50)..(50): c or u
  modified_base (60)..(60): c or u
  modified_base (81)..(81): c or u
  modified_base (83)..(83): c or u
  modified_base (92)..(92): c or u
  modified_base (94)..(94): c or u
  modified_base (96)..(96): c or u
  modified_base (111)..(111): c or u
  modified_base (120)..(120): c or u
  modified_base (137)..(137): c or u
  modified_base (143)..(143): c or u
  modified_base (146)..(146): c or u
  modified_base (149)..(149): c or u
  modified_base (152)..(152): c or u
  modified_base (161)..(161): c or u
  modified_base (164)..(164): c or u
  modified_base (192)..(192): c or u
  modified_base (195)..(195): c or u
  modified_base (213)..(213): c or u
  modified_base (222)..(222): c or u
  modified_base (225)..(225): c or u
  modified_base (230)..(230): c or u
  modified_base (235)..(235): c or u
  modified_base (243)..(243): c or u
  modified_base (246)..(246): c or u
  modified_base (260)..(260): c or u
  modified_base (264)..(264): c or u
  modified_base (267)..(267): c or u
  modified_base (271)..(271): c or u
  modified_base (278)..(278): c or u
  modified_base (284)..(284): c or u
  modified_base (286)..(286): c or u
  modified_base (289)..(289): c or u
  modified_base (296)..(296): c or u
gngtutgutgtaatuuautaggngutguunggutgngutuaututngganguagagauungutuatgttggtgaagaagungnguuagaaungngnggutguagtuauutngaguaggunggutgutuutgguaggnggtgtnggngunggngggggautnggnguuuaggguuuuttuuagguuutuuutngungggutuuuuauuagutunggaggtggnggngatgnggaungagtgagnggnggtgggguuaggungggngungggngggagungaggungnggnggautunguaa

SEQ ID NO: 155 - DNA, 300 bp, Artificial Sequence
  Description of Artificial Sequence: Synthetic oligonucleotide
  Description of Combined DNA/RNA Molecule: Synthetic oligonucleotide
  modified_base (10)..(10): c or u
  modified_base (35)..(35): c or u
  modified_base (61)..(61): c or u
  modified_base (69)..(69): c or u
  modified_base (71)..(71): c or u
  modified_base (80)..(80): c or u
  modified_base (105)..(105): c or u
  modified_base (107)..(107): c or u
  modified_base (120)..(120): c or u
  modified_base (128)..(128): c or u
  modified_base (141)..(141): c or u
  modified_base (150)..(150): c or u
  modified_base (152)..(152): c or u
  modified_base (156)..(156): c or u
  modified_base (177)..(177): c or u
  modified_base (179)..(179): c or u
  modified_base (186)..(186): c or u
  modified_base (203)..(203): c or u
  modified_base (206)..(206): c or u
  modified_base (210)..(210): c or u
  modified_base (225)..(225): c or u
  modified_base (232)..(232): c or u
  modified_base (249)..(249): c or u
  modified_base (255)..(255): c or u
  modified_base (262)..(262): c or u
  modified_base (268)..(268): c or u
taggagguungututguauuttuuttautgtgganggguuututgagututgagguutggngggagagngngtguagutngagutuututtuuuauuuaguuuungnguuutauutggtngauuttunguaguutuaguunggtuttgungngutngtuuttguauaggtggatutngnguauuunggguttgatutuagutngunguanguuuaggutgtauunggttaunggtguuauuatutggunggguungggguungagaungutgtutguagauauuaggggguagggggtua

SEQ ID NO: 156 - DNA, 300 bp, Artificial Sequence
  Description of Artificial Sequence: Synthetic oligonucleotide
  Description of Combined DNA/RNA Molecule: Synthetic oligonucleotide
  modified_base (32)..(32): c or u
  modified_base (38)..(38): c or u
  modified_base (45)..(45): c or u
  modified_base (51)..(51): c or u
  modified_base (68)..(68): c or u
  modified_base (75)..(75): c or u
  modified_base (90)..(90): c or u
  modified_base (94)..(94): c or u
  modified_base (97)..(97): c or u
  modified_base (114)..(114): c or u
  modified_base (121)..(121): c or u
  modified_base (123)..(123): c or u
  modified_base (144)..(144): c or u
  modified_base (148)..(148): c or u
  modified_base (150)..(150): c or u
  modified_base (159)..(159): c or u
  modified_base (172)..(172): c or u
  modified_base (180)..(180): c or u
  modified_base (193)..(193): c or u
  modified_base (195)..(195): c or u
  modified_base (220)..(220): c or u
  modified_base (229)..(229): c or u
  modified_base (231)..(231): c or u
  modified_base (239)..(239): c or u
  modified_base (265)..(265): c or u
  modified_base (290)..(290): c or u
tgauuuuutguuuuutggtgtutguagauagnggtutnggguuunggguungguuagatggtgguaunggtaaungggtauaguutgggngtgnggngagutgagatuaaguunggggtgngngagatuuauutgtguaaggangagngngguaagaungggutgaggutgnggaaggtngauuaggtagggngngggggutgggtgggaagaggagutngagutguangngututuunguuagguutuagagutuagaggguungtuuauagtaaggaaggtguagagnggguutuuta

SEQ ID NO: 157 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (9)..(9): c or u
  modified_base (24)..(24): c or u
  modified_base (38)..(38): c or u
  modified_base (40)..(40): c or u
  modified_base (87)..(87): c or u
  modified_base (89)..(89): c or u
  modified_base (96)..(96): c or u
  modified_base (104)..(104): c or u
  modified_base (110)..(110): c or u
  modified_base (112)..(112): c or u
  modified_base (120)..(120): c or u
  modified_base (127)..(127): c or u
  modified_base (133)..(133): c or u
  modified_base (151)..(151): c or u
  modified_base (156)..(156): c or u
  modified_base (163)..(163): c or u
  modified_base (167)..(167): c or u
  modified_base (173)..(173): c or u
  modified_base (176)..(176): c or u
  modified_base (181)..(181): c or u
  modified_base (184)..(184): c or u
  modified_base (199)..(199): c or u
  modified_base (201)..(201): c or u
  modified_base (208)..(208): c or u
  modified_base (235)..(235): c or u
  modified_base (241)..(241): c or u
  modified_base (244)..(244): c or u
  modified_base (259)..(259): c or u
  modified_base (261)..(261): c or u
  modified_base (266)..(266): c or u
  modified_base (269)..(269): c or u
  modified_base (277)..(277): c or u
  modified_base (282)..(282): c or u
  modified_base (284)..(284): c or u
  modified_base (291)..(291): c or u
uutgtungngutuuuaguuuuuanguaguuagauauungngggtgutgagatgaagagtgaagtuauuaggagagauaggaaauagngnggguutnggggauungagggngnggaagutngggggunggggtngaguauagattgggaggnguagngutgggnguangtuuungtngguunggngguuuutaatgaggngngutgtgnguagautgutaagaguaguatgaguanggutunggngguuuuuaggguuungngggtnggnguuauuunggagngnggtguunggaatuaut

SEQ ID NO: 158 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (16)..(16): c or u
  modified_base (18)..(18): c or u
  modified_base (23)..(23): c or u
  modified_base (31)..(31): c or u
  modified_base (34)..(34): c or u
  modified_base (39)..(39): c or u
  modified_base (41)..(41): c or u
  modified_base (56)..(56): c or u
  modified_base (59)..(59): c or u
  modified_base (65)..(65): c or u
  modified_base (92)..(92): c or u
  modified_base (99)..(99): c or u
  modified_base (101)..(101): c or u
  modified_base (116)..(116): c or u
  modified_base (119)..(119): c or u
  modified_base (124)..(124): c or u
  modified_base (127)..(127): c or u
  modified_base (133)..(133): c or u
  modified_base (137)..(137): c or u
  modified_base (144)..(144): c or u
  modified_base (149)..(149): c or u
  modified_base (167)..(167): c or u
  modified_base (173)..(173): c or u
  modified_base (180)..(180): c or u
  modified_base (188)..(188): c or u
  modified_base (190)..(190): c or u
  modified_base (196)..(196): c or u
  modified_base (204)..(204): c or u
  modified_base (211)..(211): c or u
  modified_base (213)..(213): c or u
  modified_base (260)..(260): c or u
  modified_base (262)..(262): c or u
  modified_base (276)..(276): c or u
  modified_base (291)..(291): c or u
  modified_base (293)..(293): c or u
agtgattunggguaungngutunggggtggngungauungngggguuutgggggungunggagungtgutuatgutgututtaguagtutgnguauagngnguutuattaggggungungggunganggggangtgnguuuagngutgnguutuuuaatutgtgutngauuungguuuungaguttungnguuutngggtuuungagguungngutgtttuutgtututuutggtgauttuaututtuatutuaguauungngggtgtutggutgngtgggggutgggagngnggauagg

SEQ ID NO: 159 - DNA, 300 bp, Artificial Sequence
  Description of Artificial Sequence: Synthetic oligonucleotide
  Description of Combined DNA/RNA Molecule: Synthetic oligonucleotide
  modified_base (10)..(10): c or u
  modified_base (36)..(36): c or u
  modified_base (55)..(55): c or u
  modified_base (57)..(57): c or u
  modified_base (80)..(80): c or u
  modified_base (90)..(90): c or u
  modified_base (92)..(92): c or u
  modified_base (122)..(122): c or u
  modified_base (136)..(136): c or u
  modified_base (139)..(139): c or u
  modified_base (143)..(143): c or u
  modified_base (148)..(148): c or u
  modified_base (150)..(150): c or u
  modified_base (166)..(166): c or u
  modified_base (172)..(172): c or u
  modified_base (178)..(178): c or u
  modified_base (236)..(236): c or u
  modified_base (264)..(264): c or u
  modified_base (282)..(282): c or u
  modified_base (293)..(293): c or u
uatuuttuunggaaaagtauaaauagttuutuagangaggtuuuuuauutuuuangngutuuuuaguuutuuutuuutgnggagaguuungngauaguutuuuuaauauutgtgaatuatungggaggutguuaungungagngatungnguauuauuuuuttuunggguunggguangguuagggaggauagttagggttgttgutttataattatuauttttaatututaatangauuaguauaagtaguutttgtutuuunguuutgatttgaguatungaggguuuuungagguag

SEQ ID NO: 160 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (18)..(18): c or u
  modified_base (36)..(36): c or u
  modified_base (64)..(64): c or u
  modified_base (122)..(122): c or u
  modified_base (128)..(128): c or u
  modified_base (134)..(134): c or u
  modified_base (150)..(150): c or u
  modified_base (152)..(152): c or u
  modified_base (157)..(157): c or u
  modified_base (161)..(161): c or u
  modified_base (164)..(164): c or u
  modified_base (178)..(178): c or u
  modified_base (208)..(208): c or u
  modified_base (210)..(210): c or u
  modified_base (220)..(220): c or u
  modified_base (243)..(243): c or u
  modified_base (245)..(245): c or u
  modified_base (264)..(264): c or u
  modified_base (290)..(290): c or u
utguutngggggguuutnggatgutuaaatuagggnggggagauaaaggutauttgtgutggtngtattagagattaaaagtgataattataaaguaauaauuutaautgtuutuuutggungtguunggguungggaagggggtggtgngnggatngutnggnggtgguaguutuunggatgattuauaggtgttggggaggutgtngnggggututunguagggagggagggutggggagngngtgggaggtgggggauutngtutgaggaautgtttgtauttttungggaaggatg

SEQ ID NO: 161 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (8)..(8): c or u
  modified_base (29)..(29): c or u
  modified_base (54)..(54): c or u
  modified_base (61)..(61): c or u
  modified_base (63)..(63): c or u
  modified_base (73)..(73): c or u
  modified_base (78)..(78): c or u
  modified_base (87)..(87): c or u
  modified_base (91)..(91): c or u
  modified_base (95)..(95): c or u
  modified_base (97)..(97): c or u
  modified_base (99)..(99): c or u
  modified_base (107)..(107): c or u
  modified_base (109)..(109): c or u
  modified_base (111)..(111): c or u
  modified_base (114)..(114): c or u
  modified_base (116)..(116): c or u
  modified_base (126)..(126): c or u
  modified_base (130)..(130): c or u
  modified_base (137)..(137): c or u
  modified_base (144)..(144): c or u
  modified_base (157)..(157): c or u
  modified_base (163)..(163): c or u
  modified_base (173)..(173): c or u
  modified_base (175)..(175): c or u
  modified_base (177)..(177): c or u
  modified_base (183)..(183): c or u
  modified_base (185)..(185): c or u
  modified_base (195)..(195): c or u
  modified_base (206)..(206): c or u
  modified_base (209)..(209): c or u
  modified_base (213)..(213): c or u
  modified_base (225)..(225): c or u
  modified_base (230)..(230): c or u
  modified_base (239)..(239): c or u
  modified_base (242)..(242): c or u
  modified_base (244)..(244): c or u
  modified_base (259)..(259): c or u
  modified_base (262)..(262): c or u
  modified_base (281)..(281): c or u
  modified_base (289)..(289): c or u
  modified_base (292)..(292): c or u
unggagangautuuagggutgggtgaggngutgauuuuuaggagutggggtgungaggggngnggguuauagnggtgngaguuagtngggnguungngnggtggggngngnggngnggggattggngggngutuuunggtguunguagututtuagngtagungggaagagungngngtutgngnguuaguuuunguuutggguungunguungagutututggnguagngutagutungungngutuagutguuutgngungguauuuutggtuatgagnguuuuutngangutguuuu

SEQ ID NO: 162 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (11)..(11): c or u
  modified_base (19)..(19): c or u
  modified_base (38)..(38): c or u
  modified_base (41)..(41): c or u
  modified_base (56)..(56): c or u
  modified_base (58)..(58): c or u
  modified_base (61)..(61): c or u
  modified_base (70)..(70): c or u
  modified_base (75)..(75): c or u
  modified_base (87)..(87): c or u
  modified_base (91)..(91): c or u
  modified_base (94)..(94): c or u
  modified_base (105)..(105): c or u
  modified_base (115)..(115): c or u
  modified_base (117)..(117): c or u
  modified_base (123)..(123): c or u
  modified_base (125)..(125): c or u
  modified_base (127)..(127): c or u
  modified_base (137)..(137): c or u
  modified_base (143)..(143): c or u
  modified_base (156)..(156): c or u
  modified_base (163)..(163): c or u
  modified_base (170)..(170): c or u
  modified_base (174)..(174): c or u
  modified_base (184)..(184): c or u
  modified_base (186)..(186): c or u
  modified_base (189)..(189): c or u
  modified_base (191)..(191): c or u
  modified_base (193)..(193): c or u
  modified_base (201)..(201): c or u
  modified_base (203)..(203): c or u
  modified_base (205)..(205): c or u
  modified_base (209)..(209): c or u
  modified_base (213)..(213): c or u
  modified_base (222)..(222): c or u
  modified_base (227)..(227): c or u
  modified_base (237)..(237): c or u
  modified_base (239)..(239): c or u
  modified_base (246)..(246): c or u
  modified_base (271)..(271): c or u
  modified_base (292)..(292): c or u
  modified_base (298)..(298): c or u
gggguagngtngagggggngutuatgauuaggggtgunggnguaggguagutgagngnggnggagutagngutgnguuagagagutngggnggnggguuuagggngggggutggngnguagangngnggututtuunggutangutgaagagutgnggguaunggggagnguunguuaatuuungngungngnguuuuaungngngggnguungautggutnguaungutgtgguungnguuuutngguauuuuagutuutgggggtuagnguutuauuuaguuutggagtngtutungg

SEQ ID NO: 163 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (8)..(8): c or u
  modified_base (14)..(14): c or u
  modified_base (17)..(17): c or u
  modified_base (20)..(20): c or u
  modified_base (24)..(24): c or u
  modified_base (29)..(29): c or u
  modified_base (33)..(33): c or u
  modified_base (35)..(35): c or u
  modified_base (40)..(40): c or u
  modified_base (51)..(51): c or u
  modified_base (55)..(55): c or u
  modified_base (68)..(68): c or u
  modified_base (70)..(70): c or u
  modified_base (73)..(73): c or u
  modified_base (88)..(88): c or u
  modified_base (91)..(91): c or u
  modified_base (95)..(95): c or u
  modified_base (100)..(100): c or u
  modified_base (105)..(105): c or u
  modified_base (107)..(107): c or u
  modified_base (116)..(116): c or u
  modified_base (120)..(120): c or u
  modified_base (130)..(130): c or u
  modified_base (132)..(132): c or u
  modified_base (142)..(142): c or u
  modified_base (150)..(150): c or u
  modified_base (163)..(163): c or u
  modified_base (166)..(166): c or u
  modified_base (184)..(184): c or u
  modified_base (197)..(197): c or u
  modified_base (200)..(200): c or u
  modified_base (213)..(213): c or u
  modified_base (216)..(216): c or u
  modified_base (221)..(221): c or u
  modified_base (223)..(223): c or u
  modified_base (227)..(227): c or u
  modified_base (237)..(237): c or u
  modified_base (239)..(239): c or u
  modified_base (246)..(246): c or u
  modified_base (249)..(249): c or u
  modified_base (258)..(258): c or u
  modified_base (269)..(269): c or u
  modified_base (277)..(277): c or u
  modified_base (280)..(280): c or u
ngtguuanguaaangungtngtunguaunggtngngautngguaagggagngggnggagagutgautngnggnggaggggggtuautngungganggaangutgngnguaguuatngutngutgtuagungngtuuuaauungutaggangutggguuutgunggngggatuutuuuuttautnggaaaggggaggngungguuauagtaggngangagungngutngguuauuaungnggtggunggnggaauuutngututuuuuungtuauuungtngagggggaagutgaggaggg

SEQ ID NO: 164 - DNA, 300 bp, Artificial Sequence
  Description of Artificial Sequence: Synthetic oligonucleotide
  Description of Combined DNA/RNA Molecule: Synthetic oligonucleotide
  modified_base (20)..(20): c or u
  modified_base (23)..(23): c or u
  modified_base (31)..(31): c or u
  modified_base (42)..(42): c or u
  modified_base (51)..(51): c or u
  modified_base (54)..(54): c or u
  modified_base (61)..(61): c or u
  modified_base (63)..(63): c or u
  modified_base (73)..(73): c or u
  modified_base (77)..(77): c or u
  modified_base (79)..(79): c or u
  modified_base (84)..(84): c or u
  modified_base (87)..(87): c or u
  modified_base (100)..(100): c or u
  modified_base (103)..(103): c or u
  modified_base (116)..(116): c or u
  modified_base (134)..(134): c or u
  modified_base (137)..(137): c or u
  modified_base (150)..(150): c or u
  modified_base (158)..(158): c or u
  modified_base (168)..(168): c or u
  modified_base (170)..(170): c or u
  modified_base (180)..(180): c or u
  modified_base (184)..(184): c or u
  modified_base (193)..(193): c or u
  modified_base (195)..(195): c or u
  modified_base (200)..(200): c or u
  modified_base (205)..(205): c or u
  modified_base (209)..(209): c or u
  modified_base (212)..(212): c or u
  modified_base (227)..(227): c or u
  modified_base (230)..(230): c or u
  modified_base (232)..(232): c or u
  modified_base (245)..(245): c or u
  modified_base (249)..(249): c or u
  modified_base (260)..(260): c or u
  modified_base (265)..(265): c or u
  modified_base (267)..(267): c or u
  modified_base (271)..(271): c or u
  modified_base (276)..(276): c or u
  modified_base (280)..(280): c or u
  modified_base (283)..(283): c or u
  modified_base (286)..(286): c or u
  modified_base (292)..(292): c or u
  modified_base (299)..(299): c or u
uuutuutuaguttuuuuutnganggggtganggggggagagngagggttungungguuaungnggtggtggungagngnggutngtnguutautgtggunggnguutuuuutttungagtaaggggaggatuungungguaggguuuagngtuutagngggttgggangnggutgauagngagngatggutgngnguagngttungtunggngagtgauuuuuutungungngagtuagututunguungutuuuttgungagtngngaunggtgngganganggngtttgngtgguang

SEQ ID NO: 165 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (6)..(6): c or u
  modified_base (11)..(11): c or u
  modified_base (24)..(24): c or u
  modified_base (28)..(28): c or u
  modified_base (43)..(43): c or u
  modified_base (52)..(52): c or u
  modified_base (54)..(54): c or u
  modified_base (57)..(57): c or u
  modified_base (73)..(73): c or u
  modified_base (84)..(84): c or u
  modified_base (97)..(97): c or u
  modified_base (102)..(102): c or u
  modified_base (119)..(119): c or u
  modified_base (125)..(125): c or u
  modified_base (128)..(128): c or u
  modified_base (131)..(131): c or u
  modified_base (134)..(134): c or u
  modified_base (137)..(137): c or u
  modified_base (140)..(140): c or u
  modified_base (148)..(148): c or u
  modified_base (151)..(151): c or u
  modified_base (162)..(162): c or u
  modified_base (167)..(167): c or u
  modified_base (172)..(172): c or u
  modified_base (178)..(178): c or u
  modified_base (185)..(185): c or u
  modified_base (196)..(196): c or u
  modified_base (199)..(199): c or u
  modified_base (209)..(209): c or u
  modified_base (211)..(211): c or u
  modified_base (220)..(220): c or u
  modified_base (229)..(229): c or u
  modified_base (238)..(238): c or u
  modified_base (240)..(240): c or u
  modified_base (242)..(242): c or u
  modified_base (247)..(247): c or u
  modified_base (251)..(251): c or u
  modified_base (273)..(273): c or u
  modified_base (282)..(282): c or u
  modified_base (288)..(288): c or u
uunggngagangaatguaguauanggunguutttatgggguunguagauagngngtnguuaggutaauuutgngtggaaaattnggaggtggaaggngaggnguuttattgagggggungguagnggnggnggnggnggngagggggnggngggggutgtgngguungggunggaaangtgagungggutgggggnggngauuauuuungnguattuuungguuutuungggauuaungngnguuunggungguaggtggaggaguaggaggnguuutuaungtuuunguuutgggagga

SEQ ID NO: 166 - DNA, 300 bp, Artificial Sequence
  Description of Artificial Sequence: Synthetic oligonucleotide
  Description of Combined DNA/RNA Molecule: Synthetic oligonucleotide
  modified_base (12)..(12): c or u
  modified_base (18)..(18): c or u
  modified_base (27)..(27): c or u
  modified_base (49)..(49): c or u
  modified_base (53)..(53): c or u
  modified_base (58)..(58): c or u
  modified_base (60)..(60): c or u
  modified_base (62)..(62): c or u
  modified_base (71)..(71): c or u
  modified_base (80)..(80): c or u
  modified_base (89)..(89): c or u
  modified_base (91)..(91): c or u
  modified_base (101)..(101): c or u
  modified_base (104)..(104): c or u
  modified_base (115)..(115): c or u
  modified_base (122)..(122): c or u
  modified_base (128)..(128): c or u
  modified_base (133)..(133): c or u
  modified_base (138)..(138): c or u
  modified_base (149)..(149): c or u
  modified_base (152)..(152): c or u
  modified_base (160)..(160): c or u
  modified_base (163)..(163): c or u
  modified_base (166)..(166): c or u
  modified_base (169)..(169): c or u
  modified_base (172)..(172): c or u
  modified_base (175)..(175): c or u
  modified_base (181)..(181): c or u
  modified_base (198)..(198): c or u
  modified_base (203)..(203): c or u
  modified_base (216)..(216): c or u
  modified_base (227)..(227): c or u
  modified_base (243)..(243): c or u
  modified_base (246)..(246): c or u
  modified_base (248)..(248): c or u
  modified_base (257)..(257): c or u
  modified_base (272)..(272): c or u
  modified_base (276)..(276): c or u
  modified_base (289)..(289): c or u
  modified_base (294)..(294): c or u
  modified_base (297)..(297): c or u
tuutuuuagggngggganggtgagggnguutuutgutuutuuauutgunggunggggngngnggtggtuungggagggunggggaatgngngggggtggtngunguuuuuaguunggutuangtttungguungggunguauaguuuungunguuuuutngungungungungungutgungguuuuutuaataaggnguutnguuttuuauutungaattttuuanguagggttaguutggngangngutgtutgnggguuuuataaaggnggungtgtgutguattngtutngunggg

SEQ ID NO: 167 - DNA, 300 bp, Artificial Sequence
  Description of Artificial Sequence: Synthetic oligonucleotide
  Description of Combined DNA/RNA Molecule: Synthetic oligonucleotide
  modified_base (13)..(13): c or u
  modified_base (15)..(15): c or u
  modified_base (52)..(52): c or u
  modified_base (68)..(68): c or u
  modified_base (99)..(99): c or u
  modified_base (103)..(103): c or u
  modified_base (116)..(116): c or u
  modified_base (126)..(126): c or u
  modified_base (147)..(147): c or u
  modified_base (150)..(150): c or u
  modified_base (167)..(167): c or u
  modified_base (179)..(179): c or u
  modified_base (201)..(201): c or u
  modified_base (209)..(209): c or u
  modified_base (218)..(218): c or u
  modified_base (226)..(226): c or u
  modified_base (262)..(262): c or u
tutgatggtggungngtgttggguttuagtaguuuutggaguuuatutautngaaataaatatttutnggtaguuatggaagttggagutgagaaguungggngggggtguutgunggatguuuunggttuuuututtttuuuautngunguuaauttaauttttungggggatggatnggutggttgagaaagaggauanguatautnggtgtgaangaggtuangaauuututgauuuuagggagagatttutguuaagngtaaggtgtutttggatuuuuuuauututgtuuuaggt

SEQ ID NO: 168 - DNA, 300 bp, Artificial Sequence
  Description of Artificial Sequence: Synthetic oligonucleotide
  Description of Combined DNA/RNA Molecule: Synthetic oligonucleotide
  modified_base (38)..(38): c or u
  modified_base (74)..(74): c or u
  modified_base (82)..(82): c or u
  modified_base (91)..(91): c or u
  modified_base (99)..(99): c or u
  modified_base (121)..(121): c or u
  modified_base (133)..(133): c or u
  modified_base (150)..(150): c or u
  modified_base (153)..(153): c or u
  modified_base (174)..(174): c or u
  modified_base (184)..(184): c or u
  modified_base (197)..(197): c or u
  modified_base (201)..(201): c or u
  modified_base (232)..(232): c or u
  modified_base (248)..(248): c or u
  modified_base (285)..(285): c or u
  modified_base (287)..(287): c or u
auutgggauagaggtggggggatuuaaagauauuttanguttgguagaaatututuuutggggtuagagggttngtgauutngttuauaungagtatgngtgtuututttutuaauuagungatuuatuuuunggaaaagttaagttggnggngagtgggaaaagaggggaaunggggguatungguagguauuuunguunggguttutuagutuuaauttuuatggutaungagaaatatttatttngagtagatgggutuuaggggutautgaaguuuaauangngguuauuatuaga

SEQ ID NO: 169 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (6)..(6): c or u
  modified_base (10)..(10): c or u
  modified_base (15)..(15): c or u
  modified_base (18)..(18): c or u
  modified_base (21)..(21): c or u
  modified_base (30)..(30): c or u
  modified_base (33)..(33): c or u
  modified_base (36)..(36): c or u
  modified_base (39)..(39): c or u
  modified_base (42)..(42): c or u
  modified_base (45)..(45): c or u
  modified_base (48)..(48): c or u
  modified_base (51)..(51): c or u
  modified_base (61)..(61): c or u
  modified_base (69)..(69): c or u
  modified_base (75)..(75): c or u
  modified_base (82)..(82): c or u
  modified_base (86)..(86): c or u
  modified_base (90)..(90): c or u
  modified_base (93)..(93): c or u
  modified_base (106)..(106): c or u
  modified_base (108)..(108): c or u
  modified_base (112)..(112): c or u
  modified_base (115)..(115): c or u
  modified_base (118)..(118): c or u
  modified_base (138)..(138): c or u
  modified_base (145)..(145): c or u
  modified_base (148)..(148): c or u
  modified_base (150)..(150): c or u
  modified_base (155)..(155): c or u
  modified_base (167)..(167): c or u
  modified_base (174)..(174): c or u
  modified_base (180)..(180): c or u
  modified_base (183)..(183): c or u
  modified_base (187)..(187): c or u
  modified_base (196)..(196): c or u
  modified_base (203)..(203): c or u
  modified_base (211)..(211): c or u
  modified_base (217)..(217): c or u
  modified_base (224)..(224): c or u
  modified_base (226)..(226): c or u
  modified_base (231)..(231): c or u
  modified_base (243)..(243): c or u
  modified_base (246)..(246): c or u
  modified_base (257)..(257): c or u
  modified_base (267)..(267): c or u
  modified_base (270)..(270): c or u
  modified_base (272)..(272): c or u
  modified_base (279)..(279): c or u
  modified_base (293)..(293): c or u
  modified_base (296)..(296): c or u
ggnggngatnggagnggnggnggtggtutnggnggnggnggnggnggnggngguagggagngggutuunggtgunggguaungggngggnggnggggaagatgaungngggngunggngtgutuuttutgutgututngututunggngngutungggtaagttgunguutuunguuuungungttnggaaguuunggguagngggaggtngtuuunggatuungnggggngutuauauauunggnggggututuungggutuuuungungngutuuungutguatuuaguunggnguuu

SEQ ID NO: 170 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (7)..(7): c or u
  modified_base (21)..(21): c or u
  modified_base (28)..(28): c or u
  modified_base (30)..(30): c or u
  modified_base (33)..(33): c or u
  modified_base (43)..(43): c or u
  modified_base (54)..(54): c or u
  modified_base (57)..(57): c or u
  modified_base (69)..(69): c or u
  modified_base (74)..(74): c or u
  modified_base (76)..(76): c or u
  modified_base (83)..(83): c or u
  modified_base (89)..(89): c or u
  modified_base (97)..(97): c or u
  modified_base (104)..(104): c or u
  modified_base (113)..(113): c or u
  modified_base (117)..(117): c or u
  modified_base (120)..(120): c or u
  modified_base (126)..(126): c or u
  modified_base (133)..(133): c or u
  modified_base (145)..(145): c or u
  modified_base (150)..(150): c or u
  modified_base (152)..(152): c or u
  modified_base (155)..(155): c or u
  modified_base (162)..(162): c or u
  modified_base (182)..(182): c or u
  modified_base (185)..(185): c or u
  modified_base (188)..(188): c or u
  modified_base (192)..(192): c or u
  modified_base (194)..(194): c or u
  modified_base (207)..(207): c or u
  modified_base (210)..(210): c or u
  modified_base (214)..(214): c or u
  modified_base (218)..(218): c or u
  modified_base (225)..(225): c or u
  modified_base (231)..(231): c or u
  modified_base (239)..(239): c or u
  modified_base (249)..(249): c or u
  modified_base (252)..(252): c or u
  modified_base (255)..(255): c or u
  modified_base (258)..(258): c or u
  modified_base (261)..(261): c or u
  modified_base (264)..(264): c or u
  modified_base (267)..(267): c or u
  modified_base (270)..(270): c or u
  modified_base (279)..(279): c or u
  modified_base (282)..(282): c or u
  modified_base (285)..(285): c or u
  modified_base (290)..(290): c or u
  modified_base (294)..(294): c or u
  modified_base (297)..(297): c or u
gggngungggutggatguagnggggagngnggngggggaguungggagaguuungungggtgtgtgagnguuungngggatunggggangauutuungutguungggguttungaanggngggggngggaggngguaauttauunggagngngunggagagngagaguaguagaaggaguangunggnguungnggtuatuttuuungunguunguunggtguungguaungggaguungutuuutgungungungungungungungungagauuaungungungutungatngunguu

SEQ ID NO: 171 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (4)..(4): c or u
  modified_base (9)..(9): c or u
  modified_base (17)..(17): c or u
  modified_base (20)..(20): c or u
  modified_base (33)..(33): c or u
  modified_base (50)..(50): c or u
  modified_base (58)..(58): c or u
  modified_base (61)..(61): c or u
  modified_base (76)..(76): c or u
  modified_base (82)..(82): c or u
  modified_base (85)..(85): c or u
  modified_base (93)..(93): c or u
  modified_base (112)..(112): c or u
  modified_base (123)..(123): c or u
  modified_base (131)..(131): c or u
  modified_base (135)..(135): c or u
  modified_base (138)..(138): c or u
  modified_base (142)..(142): c or u
  modified_base (146)..(146): c or u
  modified_base (148)..(148): c or u
  modified_base (151)..(151): c or u
  modified_base (153)..(153): c or u
  modified_base (161)..(161): c or u
  modified_base (166)..(166): c or u
  modified_base (174)..(174): c or u
  modified_base (178)..(178): c or u
  modified_base (187)..(187): c or u
  modified_base (206)..(206): c or u
  modified_base (208)..(208): c or u
  modified_base (213)..(213): c or u
  modified_base (234)..(234): c or u
  modified_base (241)..(241): c or u
  modified_base (248)..(248): c or u
  modified_base (250)..(250): c or u
  modified_base (255)..(255): c or u
  modified_base (257)..(257): c or u
  modified_base (270)..(270): c or u
  modified_base (272)..(272): c or u
  modified_base (275)..(275): c or u
  modified_base (281)..(281): c or u
  modified_base (287)..(287): c or u
  modified_base (297)..(297): c or u
ungngutgngggtgggnggnggggtaggautgngggguaututuauuuungaguuutnggnggggutggaguutgngtgtunggngggguuungggggutgggagutgggunggguttgggungggaagunggangungggngggngnggngngggagggnguuungggagggngagngggtutuungutguututguagaguuungngggunggattguuagutttgututgnguutggngaggtgngngguungnggggguagagagngnggnggutungggggnguuuutgggngga

SEQ ID NO: 172 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (13)..(13): c or u
  modified_base (19)..(19): c or u
  modified_base (25)..(25): c or u
  modified_base (28)..(28): c or u
  modified_base (30)..(30): c or u
  modified_base (43)..(43): c or u
  modified_base (45)..(45): c or u
  modified_base (50)..(50): c or u
  modified_base (52)..(52): c or u
  modified_base (59)..(59): c or u
  modified_base (66)..(66): c or u
  modified_base (87)..(87): c or u
  modified_base (92)..(92): c or u
  modified_base (94)..(94): c or u
  modified_base (113)..(113): c or u
  modified_base (122)..(122): c or u
  modified_base (126)..(126): c or u
  modified_base (134)..(134): c or u
  modified_base (139)..(139): c or u
  modified_base (147)..(147): c or u
  modified_base (149)..(149): c or u
  modified_base (152)..(152): c or u
  modified_base (154)..(154): c or u
  modified_base (158)..(158): c or u
  modified_base (162)..(162): c or u
  modified_base (165)..(165): c or u
  modified_base (169)..(169): c or u
  modified_base (177)..(177): c or u
  modified_base (188)..(188): c or u
  modified_base (207)..(207): c or u
  modified_base (215)..(215): c or u
  modified_base (218)..(218): c or u
  modified_base (224)..(224): c or u
  modified_base (239)..(239): c or u
  modified_base (242)..(242): c or u
  modified_base (250)..(250): c or u
  modified_base (267)..(267): c or u
  modified_base (280)..(280): c or u
  modified_base (283)..(283): c or u
  modified_base (291)..(291): c or u
  modified_base (296)..(296): c or u
  modified_base (298)..(298): c or u
tunguuuaggggnguuuunggagungungngutututguuuungngggungnguauutnguuaggnguagaguaaagutgguaatungguungnggggututguagagguagngggagauungutnguuutuunggggnguuutuungngungnguunguunggngtungguttuungguuuaaguungguuuagutuuuaguuuungggguuungunggauanguaggutuuaguuungungagggutngggggtgagagtguuunguagtuutauuungunguuuauunguagngngg

SEQ ID NO: 173 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (6)..(6): c or u
  modified_base (10)..(10): c or u
  modified_base (12)..(12): c or u
  modified_base (19)..(19): c or u
  modified_base (22)..(22): c or u
  modified_base (24)..(24): c or u
  modified_base (26)..(26): c or u
  modified_base (38)..(38): c or u
  modified_base (49)..(49): c or u
  modified_base (54)..(54): c or u
  modified_base (56)..(56): c or u
  modified_base (65)..(65): c or u
  modified_base (77)..(77): c or u
  modified_base (87)..(87): c or u
  modified_base (94)..(94): c or u
  modified_base (101)..(101): c or u
  modified_base (104)..(104): c or u
  modified_base (106)..(106): c or u
  modified_base (110)..(110): c or u
  modified_base (122)..(122): c or u
  modified_base (128)..(128): c or u
  modified_base (136)..(136): c or u
  modified_base (140)..(140): c or u
  modified_base (142)..(142): c or u
  modified_base (148)..(148): c or u
  modified_base (151)..(151): c or u
  modified_base (154)..(154): c or u
  modified_base (170)..(170): c or u
  modified_base (172)..(172): c or u
  modified_base (179)..(179): c or u
  modified_base (182)..(182): c or u
  modified_base (189)..(189): c or u
  modified_base (193)..(193): c or u
  modified_base (197)..(197): c or u
  modified_base (202)..(202): c or u
  modified_base (209)..(209): c or u
  modified_base (211)..(211): c or u
  modified_base (213)..(213): c or u
  modified_base (219)..(219): c or u
  modified_base (222)..(222): c or u
  modified_base (225)..(225): c or u
  modified_base (228)..(228): c or u
  modified_base (239)..(239): c or u
  modified_base (241)..(241): c or u
  modified_base (243)..(243): c or u
  modified_base (252)..(252): c or u
  modified_base (258)..(258): c or u
  modified_base (262)..(262): c or u
  modified_base (266)..(266): c or u
  modified_base (268)..(268): c or u
  modified_base (272)..(272): c or u
  modified_base (283)..(283): c or u
  modified_base (288)..(288): c or u
uunggngtungngtuuuunggngngnguuttggggaungggttggtggnguuungngtgggguunggtggguttuunggagggttungggggtngguutgnggngngtgngggggaggaganggttungggggaunggungngautgnggnggnggtggtggggggagungnggggatngungagggunggtnggunguuungggtgungngnggtgungunggnggnggtgagguuungngngtgtgtuunggutgnggtnggungngutngaggggtuuungtggngtuuuuttuuuu

SEQ ID NO: 174 - DNA, 300 bp, Artificial Sequence
  Description of Artificial Sequence: Synthetic oligonucleotide
  Description of Combined DNA/RNA Molecule: Synthetic oligonucleotide
  modified_base (12)..(12): c or u
  modified_base (17)..(17): c or u
  modified_base (28)..(28): c or u
  modified_base (32)..(32): c or u
  modified_base (34)..(34): c or u
  modified_base (38)..(38): c or u
  modified_base (42)..(42): c or u
  modified_base (48)..(48): c or u
  modified_base (57)..(57): c or u
  modified_base (59)..(59): c or u
  modified_base (61)..(61): c or u
  modified_base (72)..(72): c or u
  modified_base (75)..(75): c or u
  modified_base (78)..(78): c or u
  modified_base (81)..(81): c or u
  modified_base (87)..(87): c or u
  modified_base (89)..(89): c or u
  modified_base (91)..(91): c or u
  modified_base (98)..(98): c or u
  modified_base (103)..(103): c or u
  modified_base (107)..(107): c or u
  modified_base (111)..(111): c or u
  modified_base (118)..(118): c or u
  modified_base (121)..(121): c or u
  modified_base (128)..(128): c or u
  modified_base (130)..(130): c or u
  modified_base (146)..(146): c or u
  modified_base (149)..(149): c or u
  modified_base (152)..(152): c or u
  modified_base (158)..(158): c or u
  modified_base (160)..(160): c or u
  modified_base (164)..(164): c or u
  modified_base (172)..(172): c or u
  modified_base (178)..(178): c or u
  modified_base (190)..(190): c or u
  modified_base (194)..(194): c or u
  modified_base (196)..(196): c or u
  modified_base (199)..(199): c or u
  modified_base (206)..(206): c or u
  modified_base (213)..(213): c or u
  modified_base (223)..(223): c or u
  modified_base (235)..(235): c or u
  modified_base (244)..(244): c or u
  modified_base (246)..(246): c or u
  modified_base (251)..(251): c or u
  modified_base (262)..(262): c or u
  modified_base (274)..(274): c or u
  modified_base (276)..(276): c or u
  modified_base (278)..(278): c or u
  modified_base (281)..(281): c or u
  modified_base (288)..(288): c or u
  modified_base (290)..(290): c or u
  modified_base (294)..(294): c or u
  modified_base (297)..(297): c or u
ggggaagggganguuanggggauuuutngagngnggungaunguagungggauauangngngggguutuaungungunggngguaungngngguauunggggnggungaungguuutnggngatuuungnggutuuuuuuauuaungungunguagtngnggunggtuuuunggaaungtutuutuuuunguangngunguaggungauuuunggaauuutungggaaguuuaunggguuuuangnggggnguuauuaauunggtuuuuaaggngngngungggggangnggangunggg

SEQ ID NO: 175 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (10)..(10): c or u
  modified_base (19)..(19): c or u
  modified_base (22)..(22): c or u
  modified_base (27)..(27): c or u
  modified_base (33)..(33): c or u
  modified_base (37)..(37): c or u
  modified_base (47)..(47): c or u
  modified_base (57)..(57): c or u
  modified_base (62)..(62): c or u
  modified_base (70)..(70): c or u
  modified_base (75)..(75): c or u
  modified_base (80)..(80): c or u
  modified_base (83)..(83): c or u
  modified_base (85)..(85): c or u
  modified_base (92)..(92): c or u
  modified_base (98)..(98): c or u
  modified_base (103)..(103): c or u
  modified_base (110)..(110): c or u
  modified_base (119)..(119): c or u
  modified_base (121)..(121): c or u
  modified_base (132)..(132): c or u
  modified_base (137)..(137): c or u
  modified_base (141)..(141): c or u
  modified_base (146)..(146): c or u
  modified_base (150)..(150): c or u
  modified_base (153)..(153): c or u
  modified_base (156)..(156): c or u
  modified_base (159)..(159): c or u
  modified_base (170)..(170): c or u
  modified_base (179)..(179): c or u
  modified_base (181)..(181): c or u
  modified_base (186)..(186): c or u
  modified_base (189)..(189): c or u
  modified_base (194)..(194): c or u
  modified_base (198)..(198): c or u
  modified_base (201)..(201): c or u
  modified_base (203)..(203): c or u
  modified_base (205)..(205): c or u
  modified_base (207)..(207): c or u
  modified_base (211)..(211): c or u
  modified_base (215)..(215): c or u
  modified_base (219)..(219): c or u
  modified_base (221)..(221): c or u
  modified_base (226)..(226): c or u
  modified_base (239)..(239): c or u
  modified_base (247)..(247): c or u
  modified_base (251)..(251): c or u
  modified_base (255)..(255): c or u
  modified_base (258)..(258): c or u
  modified_base (265)..(265): c or u
  modified_base (272)..(272): c or u
  modified_base (279)..(279): c or u
  modified_base (287)..(287): c or u
  modified_base (291)..(291): c or u
  modified_base (295)..(295): c or u
uutttutngnguuttuuungtnguuungguutnguungtggtututngtuttutuungguungututtungaaungggtnggngngtuuuungggtgnguutnguttuunggguutgungngguuuttuuungaggngtungtuungggngtnggngtnggggagaguungtuutuuungngtggngtnguuungttnggngngngngtgnguungagngngguunggtggtuuutuunggauaggngttngtgngangtgtggngtgggtngauutunguuttgunggtngutnguuut

SEQ ID NO: 176 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (9)..(9): c or u
  modified_base (13)..(13): c or u
  modified_base (21)..(21): c or u
  modified_base (28)..(28): c or u
  modified_base (35)..(35): c or u
  modified_base (42)..(42): c or u
  modified_base (45)..(45): c or u
  modified_base (49)..(49): c or u
  modified_base (53)..(53): c or u
  modified_base (61)..(61): c or u
  modified_base (74)..(74): c or u
  modified_base (79)..(79): c or u
  modified_base (81)..(81): c or u
  modified_base (85)..(85): c or u
  modified_base (89)..(89): c or u
  modified_base (93)..(93): c or u
  modified_base (95)..(95): c or u
  modified_base (97)..(97): c or u
  modified_base (99)..(99): c or u
  modified_base (102)..(102): c or u
  modified_base (106)..(106): c or u
  modified_base (111)..(111): c or u
  modified_base (114)..(114): c or u
  modified_base (119)..(119): c or u
  modified_base (121)..(121): c or u
  modified_base (130)..(130): c or u
  modified_base (141)..(141): c or u
  modified_base (144)..(144): c or u
  modified_base (147)..(147): c or u
  modified_base (150)..(150): c or u
  modified_base (154)..(154): c or u
  modified_base (159)..(159): c or u
  modified_base (163)..(163): c or u
  modified_base (168)..(168): c or u
  modified_base (179)..(179): c or u
  modified_base (181)..(181): c or u
  modified_base (190)..(190): c or u
  modified_base (197)..(197): c or u
  modified_base (202)..(202): c or u
  modified_base (208)..(208): c or u
  modified_base (215)..(215): c or u
  modified_base (217)..(217): c or u
  modified_base (220)..(220): c or u
  modified_base (225)..(225): c or u
  modified_base (230)..(230): c or u
  modified_base (238)..(238): c or u
  modified_base (243)..(243): c or u
  modified_base (253)..(253): c or u
  modified_base (263)..(263): c or u
  modified_base (267)..(267): c or u
  modified_base (273)..(273): c or u
  modified_base (278)..(278): c or u
  modified_base (281)..(281): c or u
  modified_base (290)..(290): c or u
  modified_base (292)..(292): c or u
agggngagngaungguaaggnggaggtngauuuanguuauangtnguangaanguutgtungggagggauuaungggungngutngggnguangngngngungaanggggnganguuangnggggaggangggututuuungangunganguungggangganguutnggggaagggungngguagguungggaagngaggnguauungggggangngungauunggttnggaagagngggungggagaagangagagauuangggngaggunggggnganggggaaggngngagaaagg

SEQ ID NO: 177 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (17)..(17): c or u
  modified_base (21)..(21): c or u
  modified_base (26)..(26): c or u
  modified_base (29)..(29): c or u
  modified_base (31)..(31): c or u
  modified_base (36)..(36): c or u
  modified_base (41)..(41): c or u
  modified_base (50)..(50): c or u
  modified_base (56)..(56): c or u
  modified_base (60)..(60): c or u
  modified_base (63)..(63): c or u
  modified_base (69)..(69): c or u
  modified_base (71)..(71): c or u
  modified_base (75)..(75): c or u
  modified_base (79)..(79): c or u
  modified_base (89)..(89): c or u
  modified_base (93)..(93): c or u
  modified_base (97)..(97): c or u
  modified_base (101)..(101): c or u
  modified_base (103)..(103): c or u
  modified_base (108)..(108): c or u
  modified_base (112)..(112): c or u
  modified_base (116)..(116): c or u
  modified_base (120)..(120): c or u
  modified_base (124)..(124): c or u
  modified_base (127)..(127): c or u
  modified_base (136)..(136): c or u
  modified_base (142)..(142): c or u
  modified_base (147)..(147): c or u
  modified_base (150)..(150): c or u
  modified_base (156)..(156): c or u
  modified_base (162)..(162): c or u
  modified_base (164)..(164): c or u
  modified_base (174)..(174): c or u
  modified_base (178)..(178): c or u
  modified_base (182)..(182): c or u
  modified_base (186)..(186): c or u
  modified_base (190)..(190): c or u
  modified_base (192)..(192): c or u
  modified_base (195)..(195): c or u
  modified_base (203)..(203): c or u
  modified_base (206)..(206): c or u
  modified_base (208)..(208): c or u
  modified_base (285)..(285): c or u
  modified_base (289)..(289): c or u
  modified_base (293)..(293): c or u
gggngggtggttggggngtunggttngungnguuunguuungguuuuaunggtuunggungunguuuungnguungutngutuuutuungtunguungtungngguungtungtungtungtungtngtuutuutnguttgnggggngunggguungtuutngngagguuuuunggunggungtunggungngtngggguutngungngututauutauutauutggttgatuutguuagtaguatatguttgtutuaaagattaaguuatguatgtutaagtanguanggunggtauag

SEQ ID NO: 178 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (11)..(11): c or u
  modified_base (15)..(15): c or u
  modified_base (92)..(92): c or u
  modified_base (94)..(94): c or u
  modified_base (97)..(97): c or u
  modified_base (105)..(105): c or u
  modified_base (108)..(108): c or u
  modified_base (110)..(110): c or u
  modified_base (114)..(114): c or u
  modified_base (118)..(118): c or u
  modified_base (122)..(122): c or u
  modified_base (126)..(126): c or u
  modified_base (136)..(136): c or u
  modified_base (138)..(138): c or u
  modified_base (144)..(144): c or u
  modified_base (150)..(150): c or u
  modified_base (153)..(153): c or u
  modified_base (158)..(158): c or u
  modified_base (164)..(164): c or u
  modified_base (173)..(173): c or u
  modified_base (176)..(176): c or u
  modified_base (180)..(180): c or u
  modified_base (184)..(184): c or u
  modified_base (188)..(188): c or u
  modified_base (192)..(192): c or u
  modified_base (197)..(197): c or u
  modified_base (199)..(199): c or u
  modified_base (203)..(203): c or u
  modified_base (207)..(207): c or u
  modified_base (211)..(211): c or u
  modified_base (221)..(221): c or u
  modified_base (225)..(225): c or u
  modified_base (229)..(229): c or u
  modified_base (231)..(231): c or u
  modified_base (237)..(237): c or u
  modified_base (240)..(240): c or u
  modified_base (244)..(244): c or u
  modified_base (250)..(250): c or u
  modified_base (259)..(259): c or u
  modified_base (264)..(264): c or u
  modified_base (269)..(269): c or u
  modified_base (271)..(271): c or u
  modified_base (274)..(274): c or u
  modified_base (279)..(279): c or u
  modified_base (283)..(283): c or u
  modified_base (296)..(296): c or u
utgtaunggungtgngtauttagauatguatgguttaatutttgagauaaguatatgutautgguaggatuaauuaggtaggtaggtagagngnggngagguuungangnggungganggunggungggggguutngngagganggguunggnguuunguaagngaggaggangangganggangganggangggungnggangggnggangggagggagngagngggngngggggnggnggungggaunggtggggunggggnggggngnggngaaungganguuuuaauuauunguuu

SEQ ID NO: 179 - DNA, 300 bp, Artificial Sequence
  Description of Artificial Sequence: Synthetic oligonucleotide
  Description of Combined DNA/RNA Molecule: Synthetic oligonucleotide
  modified_base (34)..(34): c or u
  modified_base (40)..(40): c or u
  modified_base (62)..(62): c or u
  modified_base (66)..(66): c or u
  modified_base (92)..(92): c or u
  modified_base (95)..(95): c or u
  modified_base (113)..(113): c or u
  modified_base (120)..(120): c or u
  modified_base (124)..(124): c or u
  modified_base (133)..(133): c or u
  modified_base (136)..(136): c or u
  modified_base (141)..(141): c or u
  modified_base (151)..(151): c or u
  modified_base (153)..(153): c or u
  modified_base (157)..(157): c or u
  modified_base (167)..(167): c or u
  modified_base (169)..(169): c or u
  modified_base (176)..(176): c or u
  modified_base (181)..(181): c or u
  modified_base (190)..(190): c or u
  modified_base (196)..(196): c or u
  modified_base (208)..(208): c or u
  modified_base (214)..(214): c or u
  modified_base (219)..(219): c or u
  modified_base (235)..(235): c or u
  modified_base (237)..(237): c or u
  modified_base (239)..(239): c or u
  modified_base (241)..(241): c or u
  modified_base (246)..(246): c or u
  modified_base (251)..(251): c or u
  modified_base (263)..(263): c or u
  modified_base (267)..(267): c or u
  modified_base (279)..(279): c or u
  modified_base (282)..(282): c or u
  modified_base (286)..(286): c or u
  modified_base (296)..(296): c or u
tattuagautgggagutggggtuagagtgtutungtutunggagggggauuttuuagauuungggngggagggguuuauaguagggtguuunggngguuuuaggagggggtunggguutngggngaaggutgnggnguuunggaaggagungnguanguuuutguangnggtguungutgnggagguuanggatunggaggtgagagnguuuunguuungutuuutguuuaguungngngngguunggtunggggutgggggngggnguuaagaggggngungggnguagtggggngguu

SEQ ID NO: 180 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (14)..(14): c or u
  modified_base (18)..(18): c or u
  modified_base (21)..(21): c or u
  modified_base (33)..(33): c or u
  modified_base (37)..(37): c or u
  modified_base (49)..(49): c or u
  modified_base (54)..(54): c or u
  modified_base (59)..(59): c or u
  modified_base (61)..(61): c or u
  modified_base (63)..(63): c or u
  modified_base (65)..(65): c or u
  modified_base (81)..(81): c or u
  modified_base (86)..(86): c or u
  modified_base (92)..(92): c or u
  modified_base (104)..(104): c or u
  modified_base (110)..(110): c or u
  modified_base (119)..(119): c or u
  modified_base (124)..(124): c or u
  modified_base (131)..(131): c or u
  modified_base (133)..(133): c or u
  modified_base (143)..(143): c or u
  modified_base (147)..(147): c or u
  modified_base (149)..(149): c or u
  modified_base (159)..(159): c or u
  modified_base (164)..(164): c or u
  modified_base (167)..(167): c or u
  modified_base (176)..(176): c or u
  modified_base (180)..(180): c or u
  modified_base (187)..(187): c or u
  modified_base (205)..(205): c or u
  modified_base (208)..(208): c or u
  modified_base (234)..(234): c or u
  modified_base (238)..(238): c or u
  modified_base (260)..(260): c or u
  modified_base (266)..(266): c or u
ggunguuuuautgnguunggnguuuututtggnguunguuuuuaguuunggaungggungngngngggutggguagggagnggggngggggngututuauutunggatungtgguutunguagnggguaungngtguaggggngtgngnggutuuttunggggngunguaguuttnguungagguunggauuuuutuutggggungungggguauuutgutgtggguuuutuunguunggggtutggaaggtuuuuutunggaganggagauaututgauuuuagutuuuagtutgaata

SEQ ID NO: 181 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (8)..(8): c or u
  modified_base (44)..(44): c or u
  modified_base (49)..(49): c or u
  modified_base (54)..(54): c or u
  modified_base (92)..(92): c or u
  modified_base (99)..(99): c or u
  modified_base (104)..(104): c or u
  modified_base (116)..(116): c or u
  modified_base (122)..(122): c or u
  modified_base (150)..(150): c or u
  modified_base (158)..(158): c or u
  modified_base (198)..(198): c or u
  modified_base (258)..(258): c or u
  modified_base (271)..(271): c or u
  modified_base (276)..(276): c or u
  modified_base (285)..(285): c or u
gngauttngtutgguuuuaaaauutttguuutuuattuuuuagngtuunggaunggtuuttgutuatututuagggguaauauutgauuuangggguungtuunggagutututtngautungggauuagttuuuaguuuttuagtautngguataunggaaggaggattuutgutuuuttututuutuutagauuungagguttggaguttaututuuagatgagautaaaaaguuutaaattaatuuuuutatagnguauuuutuuutnguagnguuutggtnggggguutuuattgt

SEQ ID NO: 182 - DNA, 300 bp, Artificial Sequence
  Description of Artificial Sequence: Synthetic oligonucleotide
  Description of Combined DNA/RNA Molecule: Synthetic oligonucleotide
  modified_base (15)..(15): c or u
  modified_base (24)..(24): c or u
  modified_base (29)..(29): c or u
  modified_base (42)..(42): c or u
  modified_base (102)..(102): c or u
  modified_base (142)..(142): c or u
  modified_base (150)..(150): c or u
  modified_base (178)..(178): c or u
  modified_base (184)..(184): c or u
  modified_base (196)..(196): c or u
  modified_base (201)..(201): c or u
  modified_base (208)..(208): c or u
  modified_base (246)..(246): c or u
  modified_base (251)..(251): c or u
  modified_base (256)..(256): c or u
  modified_base (292)..(292): c or u
  modified_base (298)..(298): c or u
auaatggagguuuungauuagggngutgngagggaggggtgngutatagggggattaatttagggutttttagtutuatutggagagtaagutuuaaguutnggggtutaggaggagagaagggaguaggaatuutuuttunggtatgungagtautgaagggutgggaautggtuunggagtngaagagagutunggganggguuungtgggtuaggtgttguuuutgagagatgaguaaggaunggtungggangutggggaatggaggguaaaggttttgggguuagangaagtngu

SEQ ID NO: 183 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (8)..(8): c or u
  modified_base (16)..(16): c or u
  modified_base (32)..(32): c or u
  modified_base (47)..(47): c or u
  modified_base (49)..(49): c or u
  modified_base (52)..(52): c or u
  modified_base (64)..(64): c or u
  modified_base (82)..(82): c or u
  modified_base (93)..(93): c or u
  modified_base (114)..(114): c or u
  modified_base (119)..(119): c or u
  modified_base (142)..(142): c or u
  modified_base (147)..(147): c or u
  modified_base (151)..(151): c or u
  modified_base (162)..(162): c or u
  modified_base (165)..(165): c or u
  modified_base (194)..(194): c or u
  modified_base (200)..(200): c or u
  modified_base (244)..(244): c or u
  modified_base (285)..(285): c or u
  modified_base (290)..(290): c or u
  modified_base (296)..(296): c or u
  modified_base (298)..(298): c or u
uuanggungaggggunggagutguututgtgngagggaguuutggungnggnguaggtaggaunggggaauuuaaggagggngggaggaaagnguuuutggtgggggaggggungtggnggggtutggggguuaagggutungggungaangagggguauangunggaguagutuuaguutgggaguattgggngtgaangtgggggaaagtagggauuagattauaggatuaaggutttuuunggutuagaautggattgttuagtguuuutagaagggguagngggtnguuuangnga

SEQ ID NO: 184 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (4)..(4): c or u
  modified_base (10)..(10): c or u
  modified_base (15)..(15): c or u
  modified_base (56)..(56): c or u
  modified_base (100)..(100): c or u
  modified_base (106)..(106): c or u
  modified_base (135)..(135): c or u
  modified_base (138)..(138): c or u
  modified_base (149)..(149): c or u
  modified_base (153)..(153): c or u
  modified_base (158)..(158): c or u
  modified_base (181)..(181): c or u
  modified_base (186)..(186): c or u
  modified_base (207)..(207): c or u
  modified_base (218)..(218): c or u
  modified_base (236)..(236): c or u
  modified_base (248)..(248): c or u
  modified_base (251)..(251): c or u
  modified_base (253)..(253): c or u
  modified_base (268)..(268): c or u
  modified_base (284)..(284): c or u
  modified_base (292)..(292): c or u
  modified_base (296)..(296): c or u
tngngtgggngauungutguuuuttutagggguautgaauaatuuagttutgagunggggaaaguuttgatuutgtaatutggtuuutautttuuuuuangttuanguuuaatgutuuuaggutggagutgutunggngtgtguuuutngttngguunggaguuuttgguuuuuagauuunguuangguuuutuuuuuauuaggggngutttuutuunguuutuuttgggttuuunggtuutauutgngungngguuagggutuuutnguauagagguagutungguuuutnggungtgg

SEQ ID NO: 185 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (16)..(16): c or u
  modified_base (20)..(20): c or u
  modified_base (27)..(27): c or u
  modified_base (29)..(29): c or u
  modified_base (37)..(37): c or u
  modified_base (49)..(49): c or u
  modified_base (55)..(55): c or u
  modified_base (58)..(58): c or u
  modified_base (65)..(65): c or u
  modified_base (81)..(81): c or u
  modified_base (88)..(88): c or u
  modified_base (92)..(92): c or u
  modified_base (94)..(94): c or u
  modified_base (113)..(113): c or u
  modified_base (121)..(121): c or u
  modified_base (124)..(124): c or u
  modified_base (127)..(127): c or u
  modified_base (133)..(133): c or u
  modified_base (135)..(135): c or u
  modified_base (145)..(145): c or u
  modified_base (150)..(150): c or u
  modified_base (154)..(154): c or u
  modified_base (164)..(164): c or u
  modified_base (166)..(166): c or u
  modified_base (178)..(178): c or u
  modified_base (192)..(192): c or u
  modified_base (194)..(194): c or u
  modified_base (202)..(202): c or u
  modified_base (215)..(215): c or u
  modified_base (237)..(237): c or u
  modified_base (250)..(250): c or u
  modified_base (274)..(274): c or u
  modified_base (281)..(281): c or u
  modified_base (294)..(294): c or u
  modified_base (296)..(296): c or u
gagaanggagutguungtgnggggtgngnguuaaggngggggauagganggguunggngtutgungagauutaggutguunguattungutngnggutuuuuttutguutuungututagnggngunggagungngutgguuuunguuunguungguagutuungngagtuagaguunggtguuuuuagaungnggguagtngggguutuattunggguuagaguaggaaagaguungauuuauutuutnggttuttuuagggaauuuuttutnggagggnguuutggguutungnguua

SEQ ID NO: 186 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (6)..(6): c or u
  modified_base (19)..(19): c or u
  modified_base (26)..(26): c or u
  modified_base (50)..(50): c or u
  modified_base (63)..(63): c or u
  modified_base (85)..(85): c or u
  modified_base (98)..(98): c or u
  modified_base (106)..(106): c or u
  modified_base (108)..(108): c or u
  modified_base (122)..(122): c or u
  modified_base (134)..(134): c or u
  modified_base (136)..(136): c or u
  modified_base (146)..(146): c or u
  modified_base (150)..(150): c or u
  modified_base (155)..(155): c or u
  modified_base (165)..(165): c or u
  modified_base (167)..(167): c or u
  modified_base (173)..(173): c or u
  modified_base (176)..(176): c or u
  modified_base (179)..(179): c or u
  modified_base (187)..(187): c or u
  modified_base (206)..(206): c or u
  modified_base (208)..(208): c or u
  modified_base (212)..(212): c or u
  modified_base (219)..(219): c or u
  modified_base (235)..(235): c or u
  modified_base (242)..(242): c or u
  modified_base (245)..(245): c or u
  modified_base (251)..(251): c or u
  modified_base (263)..(263): c or u
  modified_base (271)..(271): c or u
  modified_base (273)..(273): c or u
  modified_base (280)..(280): c or u
  modified_base (284)..(284): c or u
  modified_base (294)..(294): c or u
tggngnggagguuuagggnguuutungagaaggggttuuutggaagaaungaggaggtgggtngggututttuutgututgguunggaatgagguuungautguungnggtutggggguaungggututgautngngggagutgungggnggggnggggguuagngnggutunggngungutagagngggagguagaaggggagungngagnggaatgnggguaguutaggtutngguagangunggguungtuutgtuuuunguuttggngnguauuunguanggguagutungttutu

SEQ ID NO: 187 - DNA, 300 bp, Artificial Sequence
  Description of Artificial Sequence: Synthetic oligonucleotide
  Description of Combined DNA/RNA Molecule: Synthetic oligonucleotide
  modified_base (24)..(24): c or u
  modified_base (29)..(29): c or u
  modified_base (41)..(41): c or u
  modified_base (48)..(48): c or u
  modified_base (52)..(52): c or u
  modified_base (58)..(58): c or u
  modified_base (60)..(60): c or u
  modified_base (67)..(67): c or u
  modified_base (74)..(74): c or u
  modified_base (82)..(82): c or u
  modified_base (101)..(101): c or u
  modified_base (103)..(103): c or u
  modified_base (108)..(108): c or u
  modified_base (112)..(112): c or u
  modified_base (126)..(126): c or u
  modified_base (128)..(128): c or u
  modified_base (135)..(135): c or u
  modified_base (138)..(138): c or u
  modified_base (148)..(148): c or u
  modified_base (151)..(151): c or u
  modified_base (163)..(163): c or u
  modified_base (165)..(165): c or u
  modified_base (169)..(169): c or u
  modified_base (186)..(186): c or u
  modified_base (197)..(197): c or u
  modified_base (209)..(209): c or u
  modified_base (213)..(213): c or u
  modified_base (224)..(224): c or u
  modified_base (226)..(226): c or u
  modified_base (229)..(229): c or u
  modified_base (232)..(232): c or u
  modified_base (235)..(235): c or u
  modified_base (238)..(238): c or u
  modified_base (247)..(247): c or u
  modified_base (251)..(251): c or u
  modified_base (257)..(257): c or u
  modified_base (263)..(263): c or u
  modified_base (271)..(271): c or u
  modified_base (274)..(274): c or u
  modified_base (278)..(278): c or u
  modified_base (281)..(281): c or u
  modified_base (286)..(286): c or u
  modified_base (288)..(288): c or u
  modified_base (299)..(299): c or u
agtaggtgaauttgaggtagaagngggangtgtauttutunggutgunggtnggggtngnggututngttgagngtgtuuungaagauutuuttgguuagngngatgnguunguauauuatgatgngnguuauangunggaatttggngtngguutggttgtngnguanggtggtgtaggaguuunggtaguuuagngtgaggaaguungagnguttgtuutgngngungungungunguuauuaungtgngutuunggguungaggguanggnggungunguuungnguaguaguagng

SEQ ID NO: 188 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (12)..(12): c or u
  modified_base (14)..(14): c or u
  modified_base (19)..(19): c or u
  modified_base (22)..(22): c or u
  modified_base (26)..(26): c or u
  modified_base (29)..(29): c or u
  modified_base (37)..(37): c or u
  modified_base (43)..(43): c or u
  modified_base (49)..(49): c or u
  modified_base (53)..(53): c or u
  modified_base (62)..(62): c or u
  modified_base (65)..(65): c or u
  modified_base (68)..(68): c or u
  modified_base (71)..(71): c or u
  modified_base (74)..(74): c or u
  modified_base (76)..(76): c or u
  modified_base (87)..(87): c or u
  modified_base (91)..(91): c or u
  modified_base (103)..(103): c or u
  modified_base (114)..(114): c or u
  modified_base (131)..(131): c or u
  modified_base (135)..(135): c or u
  modified_base (137)..(137): c or u
  modified_base (149)..(149): c or u
  modified_base (152)..(152): c or u
  modified_base (162)..(162): c or u
  modified_base (165)..(165): c or u
  modified_base (172)..(172): c or u
  modified_base (174)..(174): c or u
  modified_base (188)..(188): c or u
  modified_base (192)..(192): c or u
  modified_base (197)..(197): c or u
  modified_base (199)..(199): c or u
  modified_base (218)..(218): c or u
  modified_base (226)..(226): c or u
  modified_base (233)..(233): c or u
  modified_base (240)..(240): c or u
  modified_base (242)..(242): c or u
  modified_base (248)..(248): c or u
  modified_base (252)..(252): c or u
  modified_base (259)..(259): c or u
  modified_base (271)..(271): c or u
  modified_base (276)..(276): c or u
ngutgutgutgngnggggnggnggungungtguuutnggguungggagnguanggtggtggnggnggnggnggngnguaggauaagngutnggguttuutuangutgggutaunggggutuutauauuaungtgngngauaauuaggunganguuaaattunggngtgtggngnguatuatggtgtgngggnguatngngutgguuaaggaggtuttnggggauangutuaangagagungngauuungaungguagunggagaagtauangtuunguttutauutuaagttuauutaut

SEQ ID NO: 189 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (5)..(5): c or u
  modified_base (14)..(14): c or u
  modified_base (40)..(40): c or u
  modified_base (42)..(42): c or u
  modified_base (52)..(52): c or u
  modified_base (56)..(56): c or u
  modified_base (60)..(60): c or u
  modified_base (70)..(70): c or u
  modified_base (85)..(85): c or u
  modified_base (112)..(112): c or u
  modified_base (125)..(125): c or u
  modified_base (128)..(128): c or u
  modified_base (151)..(151): c or u
  modified_base (160)..(160): c or u
  modified_base (164)..(164): c or u
  modified_base (168)..(168): c or u
  modified_base (208)..(208): c or u
  modified_base (211)..(211): c or u
  modified_base (217)..(217): c or u
  modified_base (222)..(222): c or u
  modified_base (235)..(235): c or u
  modified_base (252)..(252): c or u
  modified_base (285)..(285): c or u
gungngauuuutgngutuuuaguaggguuaagaggauutngnggguauuagngtungggngggaagggangtgtguuuaaguutnguutuutgguuutuagtgggutggganguuuttgatuaunggnguaggaaagaggutuuuuaguungtgaguttngtungggnguuaggguagggatggutggtggtgtguautggagaguanganggtgangutgngtgggaaagagangtgggaaggguatagunggattatuuautuagutuuaattttutuuaagnguuautuauuuuaua

SEQ ID NO: 190 - DNA, 300 bp, Artificial Sequence
  Description of Artificial Sequence: Synthetic oligonucleotide
  Description of Combined DNA/RNA Molecule: Synthetic oligonucleotide
  modified_base (15)..(15): c or u
  modified_base (48)..(48): c or u
  modified_base (65)..(65): c or u
  modified_base (78)..(78): c or u
  modified_base (83)..(83): c or u
  modified_base (89)..(89): c or u
  modified_base (92)..(92): c or u
  modified_base (132)..(132): c or u
  modified_base (136)..(136): c or u
  modified_base (140)..(140): c or u
  modified_base (149)..(149): c or u
  modified_base (172)..(172): c or u
  modified_base (175)..(175): c or u
  modified_base (188)..(188): c or u
  modified_base (215)..(215): c or u
  modified_base (230)..(230): c or u
  modified_base (240)..(240): c or u
  modified_base (244)..(244): c or u
  modified_base (248)..(248): c or u
  modified_base (258)..(258): c or u
  modified_base (260)..(260): c or u
  modified_base (286)..(286): c or u
  modified_base (295)..(295): c or u
  modified_base (297)..(297): c or u
tgtggggtgagtggnguttggagaaaattggagutgagtggataatunggutatguuuttuuuangtututttuuuanguagngtuaungtngtgututuuagtguauauuauuaguuatuuutguuutggnguunggangaagutuangggutggggaguututttuutgngunggtgatuaagggngtuuuaguuuautgaggguuaggaggngagguttggguauangtuuuttuunguunggangutggtguungngaggtuututtgguuutgutgggagnguaggggtngnggu

SEQ ID NO: 191 - DNA, 300 bp, Artificial Sequence
  Description of Artificial Sequence: Synthetic oligonucleotide
  Description of Combined DNA/RNA Molecule: Synthetic oligonucleotide
  modified_base (21)..(21): c or u
  modified_base (23)..(23): c or u
  modified_base (34)..(34): c or u
  modified_base (52)..(52): c or u
  modified_base (67)..(67): c or u
  modified_base (81)..(81): c or u
  modified_base (90)..(90): c or u
  modified_base (108)..(108): c or u
  modified_base (113)..(113): c or u
  modified_base (119)..(119): c or u
  modified_base (138)..(138): c or u
  modified_base (143)..(143): c or u
  modified_base (150)..(150): c or u
  modified_base (159)..(159): c or u
  modified_base (165)..(165): c or u
  modified_base (167)..(167): c or u
  modified_base (176)..(176): c or u
  modified_base (180)..(180): c or u
  modified_base (191)..(191): c or u
  modified_base (198)..(198): c or u
  modified_base (221)..(221): c or u
  modified_base (234)..(234): c or u
  modified_base (239)..(239): c or u
  modified_base (251)..(251): c or u
  modified_base (266)..(266): c or u
  modified_base (269)..(269): c or u
  modified_base (272)..(272): c or u
  modified_base (291)..(291): c or u
ctgggtttggagttgggtagngnggccaggtganggtctccttccctgggcngtcagggctgcaggnggctgtgacactcnggaggcctngacagaggggtcccaggngcagngtaccngggctcctcttgcctcagnggagngtcccanggcagtccnggaccngngcctctccngccnggctcctgcangcccagngagcctgcagcctgggatcctcngctcctgcatccnggctngggatgggtccnggctccccacctcangcnggnggggccaccctttcactcngcctccatc

SEQ ID NO: 192 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (28)..(28): c or u
  modified_base (31)..(31): c or u
  modified_base (34)..(34): c or u
  modified_base (49)..(49): c or u
  modified_base (61)..(61): c or u
  modified_base (66)..(66): c or u
  modified_base (79)..(79): c or u
  modified_base (102)..(102): c or u
  modified_base (109)..(109): c or u
  modified_base (120)..(120): c or u
  modified_base (124)..(124): c or u
  modified_base (133)..(133): c or u
  modified_base (135)..(135): c or u
  modified_base (141)..(141): c or u
  modified_base (150)..(150): c or u
  modified_base (157)..(157): c or u
  modified_base (162)..(162): c or u
  modified_base (181)..(181): c or u
  modified_base (187)..(187): c or u
  modified_base (192)..(192): c or u
  modified_base (210)..(210): c or u
  modified_base (219)..(219): c or u
  modified_base (233)..(233): c or u
  modified_base (248)..(248): c or u
  modified_base (266)..(266): c or u
  modified_base (277)..(277): c or u
  modified_base (279)..(279): c or u
gatggaggnggagtgaaagggtggcccngcnggngtgaggtggggagcngggacccatccngagcngggatgcaggagnggaggatcccaggctgcaggctngctgggngtgcaggagcngggngggagaggngngggtcngggactgcngtgggangctcngctgaggcaagaggagccngggtangctgngcctgggacccctctgtngaggcctcnggagtgtcacagcngcctgcagccctganggcccagggaaggagacngtcacctggcngngctacccaactccaaacccag

SEQ ID NO: 193 - DNA, 300 bp, Artificial Sequence
  Description of Artificial Sequence: Synthetic oligonucleotide
  Description of Combined DNA/RNA Molecule: Synthetic oligonucleotide
  modified_base (19)..(19): c or u
  modified_base (39)..(39): c or u
  modified_base (56)..(56): c or u
  modified_base (80)..(80): c or u
  modified_base (99)..(99): c or u
  modified_base (117)..(117): c or u
  modified_base (127)..(127): c or u
  modified_base (137)..(137): c or u
  modified_base (148)..(148): c or u
  modified_base (151)..(151): c or u
  modified_base (161)..(161): c or u
  modified_base (168)..(168): c or u
  modified_base (171)..(171): c or u
  modified_base (174)..(174): c or u
  modified_base (179)..(179): c or u
  modified_base (192)..(192): c or u
  modified_base (201)..(201): c or u
  modified_base (231)..(231): c or u
  modified_base (253)..(253): c or u
  modified_base (261)..(261): c or u
  modified_base (285)..(285): c or u
  modified_base (287)..(287): c or u
uuutuauututaguuuutngguttuagutuagguuuutnggggaguatuuuttgungtgagautgauaguutttgggggnguagggtuutgttututgngututaguuuatutgtgnguagaguutngttuuuaggnguutggaauunggnggguattgangtuaagngunggnggagngutguutauaganggttgauunggguuutuutuuauauuuuuttuuttuttnguutuutuuututttuutguangggggutngggutuautataaaaggtgggagngngtggtguuuuagu

SEQ ID NO: 194 - DNA, 300 bp, Artificial Sequence
  Description of Artificial Sequence: Synthetic oligonucleotide
  Description of Combined DNA/RNA Molecule: Synthetic oligonucleotide
  modified_base (13)..(13): c or u
  modified_base (15)..(15): c or u
  modified_base (39)..(39): c or u
  modified_base (47)..(47): c or u
  modified_base (69)..(69): c or u
  modified_base (99)..(99): c or u
  modified_base (108)..(108): c or u
  modified_base (121)..(121): c or u
  modified_base (126)..(126): c or u
  modified_base (129)..(129): c or u
  modified_base (132)..(132): c or u
  modified_base (139)..(139): c or u
  modified_base (149)..(149): c or u
  modified_base (152)..(152): c or u
  modified_base (163)..(163): c or u
  modified_base (173)..(173): c or u
  modified_base (183)..(183): c or u
  modified_base (201)..(201): c or u
  modified_base (220)..(220): c or u
  modified_base (244)..(244): c or u
  modified_base (261)..(261): c or u
  modified_base (281)..(281): c or u
gutgggguauuangngutuuuauuttttatagtgaguungaguuuungtguaggaaagagggaggaggngaagaaggaagggggtgtggaggaggguungggtuaaungtutgtagguagngutungunggnguttgangtuaatguungungggttuuaggnguutgggaangaggututgnguauagatgggutagagnguagagaauaggauuutgnguuuuuaaaggutgtuagtutuangguaagggatgutuuungagggguutgagutgaagungaggggutagaggtgaggg

SEQ ID NO: 195 - DNA, 300 bp, Artificial Sequence
  Description of Artificial Sequence: Synthetic oligonucleotide
  Description of Combined DNA/RNA Molecule: Synthetic oligonucleotide
  modified_base (46)..(46): c or u
  modified_base (59)..(59): c or u
  modified_base (82)..(82): c or u
  modified_base (116)..(116): c or u
  modified_base (127)..(127): c or u
  modified_base (137)..(137): c or u
  modified_base (140)..(140): c or u
  modified_base (151)..(151): c or u
  modified_base (186)..(186): c or u
  modified_base (201)..(201): c or u
  modified_base (208)..(208): c or u
  modified_base (214)..(214): c or u
  modified_base (217)..(217): c or u
  modified_base (221)..(221): c or u
  modified_base (229)..(229): c or u
  modified_base (251)..(251): c or u
  modified_base (255)..(255): c or u
  modified_base (267)..(267): c or u
  modified_base (275)..(275): c or u
  modified_base (288)..(288): c or u
  modified_base (298)..(298): c or u
ttgutgutaaatgtuauaaaagtuauutaaagguauagaggaggungututgtttttgngaaauttgutaaaattaatutgngutggguuauttguagaaaguagaauuauutuunguuuuuauutnguutuuagungunggggttuaggngtttgtgaaagauagaauutttgggutagggauunggguautggtguttngaagtungaatungunggungagaaaangauaagagaaagaaaatuuagngggngutututuuagnguuaggunggtgtaggagggngutggggutngg

SEQ ID NO: 196 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (12)..(12): c or u
  modified_base (25)..(25): c or u
  modified_base (33)..(33): c or u
  modified_base (45)..(45): c or u
  modified_base (49)..(49): c or u
  modified_base (71)..(71): c or u
  modified_base (79)..(79): c or u
  modified_base (83)..(83): c or u
  modified_base (86)..(86): c or u
  modified_base (92)..(92): c or u
  modified_base (99)..(99): c or u
  modified_base (114)..(114): c or u
  modified_base (149)..(149): c or u
  modified_base (160)..(160): c or u
  modified_base (163)..(163): c or u
  modified_base (173)..(173): c or u
  modified_base (184)..(184): c or u
  modified_base (218)..(218): c or u
  modified_base (241)..(241): c or u
  modified_base (254)..(254): c or u
ungaguuuuagnguuutuutauaungguutggngutggagagagnguungutggattttutttututtgtngttttutnggunggnggattnggauttngaaguauuagtguungggtuuutaguuuaaaggttutgtutttuauaaanguutgaauuunggnggutggaggngaggtgggggngggaggtggttutgutttutguaagtgguuuagnguagattaattttaguaagtttnguaaaaauagagngguutuututgtguutttaggtgauttttgtgauatttaguaguaa

SEQ ID NO: 197 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (7)..(7): c or u
  modified_base (17)..(17): c or u
  modified_base (24)..(24): c or u
  modified_base (26)..(26): c or u
  modified_base (28)..(28): c or u
  modified_base (34)..(34): c or u
  modified_base (41)..(41): c or u
  modified_base (57)..(57): c or u
  modified_base (65)..(65): c or u
  modified_base (68)..(68): c or u
  modified_base (93)..(93): c or u
  modified_base (113)..(113): c or u
  modified_base (121)..(121): c or u
  modified_base (150)..(150): c or u
  modified_base (153)..(153): c or u
  modified_base (161)..(161): c or u
  modified_base (174)..(174): c or u
  modified_base (176)..(176): c or u
  modified_base (191)..(191): c or u
  modified_base (193)..(193): c or u
  modified_base (198)..(198): c or u
  modified_base (226)..(226): c or u
  modified_base (238)..(238): c or u
  modified_base (241)..(241): c or u
  modified_base (244)..(244): c or u
  modified_base (275)..(275): c or u
  modified_base (284)..(284): c or u
aungagngutggaggungutuuangngngagutngaauuanggagggututuagutnggauaagngtngutgtutaagagutuuaagutuuanggaautttgattttatguungggaguunggtuatuuauttutguatutuagauaagngunggaggutngtguaguttuutngngtuututtuutggangnggggnguuuauuttagtuataguuuutggtuungguautgutuangungtnggtttuuuuautguuuaggutuuutuaguungaauuutgngtututgttuauattg

SEQ ID NO: 198 - DNA, 300 bp, Artificial Sequence
  Description of Artificial Sequence: Synthetic oligonucleotide
  Description of Combined DNA/RNA Molecule: Synthetic oligonucleotide
  modified_base (16)..(16): c or u
  modified_base (25)..(25): c or u
  modified_base (56)..(56): c or u
  modified_base (59)..(59): c or u
  modified_base (62)..(62): c or u
  modified_base (74)..(74): c or u
  modified_base (102)..(102): c or u
  modified_base (107)..(107): c or u
  modified_base (109)..(109): c or u
  modified_base (124)..(124): c or u
  modified_base (126)..(126): c or u
  modified_base (139)..(139): c or u
  modified_base (147)..(147): c or u
  modified_base (150)..(150): c or u
  modified_base (179)..(179): c or u
  modified_base (187)..(187): c or u
  modified_base (207)..(207): c or u
  modified_base (232)..(232): c or u
  modified_base (235)..(235): c or u
  modified_base (243)..(243): c or u
  modified_base (259)..(259): c or u
  modified_base (266)..(266): c or u
  modified_base (272)..(272): c or u
  modified_base (274)..(274): c or u
  modified_base (276)..(276): c or u
  modified_base (283)..(283): c or u
  modified_base (293)..(293): c or u
  modified_base (297)..(297): c or u
uaatgtgaauagaganguagggttngggutgagggaguutggguagtggggaaaunganggngtgaguagtgungggauuaggggutatgautaaggtgggnguuungngtuuaggaagaggangngaggaagutguangaguutunggnguttgtutgagatguagaagtggatgaungggutuunggguataaaatuaaagttungtggaguttggagututtagauagnganguttgtungagutgagaguuutungtggttngagutngngngtggagngguutuuagngutnggt

SEQ ID NO: 199 - DNA, 300 bp, Artificial Sequence
  Description of Artificial Sequence: Synthetic oligonucleotide
  Description of Combined DNA/RNA Molecule: Synthetic oligonucleotide
  modified_base (54)..(54): c or u
  modified_base (79)..(79): c or u
  modified_base (114)..(114): c or u
  modified_base (121)..(121): c or u
  modified_base (133)..(133): c or u
  modified_base (143)..(143): c or u
  modified_base (150)..(150): c or u
  modified_base (156)..(156): c or u
  modified_base (181)..(181): c or u
  modified_base (184)..(184): c or u
  modified_base (228)..(228): c or u
  modified_base (233)..(233): c or u
  modified_base (235)..(235): c or u
  modified_base (242)..(242): c or u
  modified_base (247)..(247): c or u
  modified_base (264)..(264): c or u
  modified_base (285)..(285): c or u
  modified_base (287)..(287): c or u
  modified_base (292)..(292): c or u
aauaguaggutgaauuagaautaagagaaaattggguagagagaagguaatggngagtuuauutaggggutggggutgnggagagutgutgutguuuttuatgutuutggggangutgtgngaguuaggatunggguagatungutautngatgunggaggagutggauaaaggutuuttngtngguaauataguuaaggauuttgggutggaguuuuaggagutggnggagngnggagtunguatngtutuuagaggtagganguagutttttguuutgaauungngaagngguagutt

SEQ ID NO: 200 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (13)..(13): c or u
  modified_base (15)..(15): c or u
  modified_base (36)..(36): c or u
  modified_base (53)..(53): c or u
  modified_base (58)..(58): c or u
  modified_base (65)..(65): c or u
  modified_base (67)..(67): c or u
  modified_base (72)..(72): c or u
  modified_base (116)..(116): c or u
  modified_base (119)..(119): c or u
  modified_base (144)..(144): c or u
  modified_base (150)..(150): c or u
  modified_base (157)..(157): c or u
  modified_base (167)..(167): c or u
  modified_base (179)..(179): c or u
  modified_base (186)..(186): c or u
  modified_base (221)..(221): c or u
  modified_base (246)..(246): c or u
aagutgunguttngngggttuaggguaaaaagutgngtuutauututggagangatgnggautungngutunguuagutuutggggutuuaguuuaaggtuuttggutatgttgungangaaggaguutttgtuuagutuutungguatngagtagnggatutguunggatuutggutnguauagngtuuuuaggaguatgaaggguaguaguagututunguaguuuuaguuuutaggtggautnguuattguuttutututguuuaattttututtagttutggttuaguutgutgtt

SEQ ID NO: 201 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (10)..(10): c or u
  modified_base (29)..(29): c or u
  modified_base (31)..(31): c or u
  modified_base (33)..(33): c or u
  modified_base (41)..(41): c or u
  modified_base (45)..(45): c or u
  modified_base (48)..(48): c or u
  modified_base (60)..(60): c or u
  modified_base (66)..(66): c or u
  modified_base (69)..(69): c or u
  modified_base (75)..(75): c or u
  modified_base (77)..(77): c or u
  modified_base (85)..(85): c or u
  modified_base (87)..(87): c or u
  modified_base (107)..(107): c or u
  modified_base (114)..(114): c or u
  modified_base (138)..(138): c or u
  modified_base (142)..(142): c or u
  modified_base (146)..(146): c or u
  modified_base (151)..(151): c or u
  modified_base (154)..(154): c or u
  modified_base (156)..(156): c or u
  modified_base (161)..(161): c or u
  modified_base (163)..(163): c or u
  modified_base (165)..(165): c or u
  modified_base (172)..(172): c or u
  modified_base (183)..(183): c or u
  modified_base (190)..(190): c or u
  modified_base (198)..(198): c or u
  modified_base (202)..(202): c or u
  modified_base (209)..(209): c or u
  modified_base (220)..(220): c or u
  modified_base (223)..(223): c or u
  modified_base (225)..(225): c or u
  modified_base (227)..(227): c or u
  modified_base (229)..(229): c or u
  modified_base (238)..(238): c or u
  modified_base (244)..(244): c or u
  modified_base (253)..(253): c or u
  modified_base (259)..(259): c or u
  modified_base (268)..(268): c or u
  modified_base (273)..(273): c or u
  modified_base (280)..(280): c or u
  modified_base (287)..(287): c or u
  modified_base (296)..(296): c or u
ggtgtuungngaguaggtgtuuaguagungngnguuuaggnguangunggguaguagutnggggtnggngttgangnggtuuagngngtauaguatgguutuuagunggtguanguuutgutuuttuttuagutguunguanguungguungungnguuungngngtguaungggaauaggunguuuagngtuaggunguunguuaggnguauagaguungungngngnguuagguunguutgnguuaguuanguuagngguaguagnguuangaguagnggutuungggututungggg

SEQ ID NO: 202 - DNA, 300 bp, Artificial Sequence
  Description of Artificial Sequence: Synthetic oligonucleotide
  Description of Combined DNA/RNA Molecule: Synthetic oligonucleotide
  modified_base (4)..(4): c or u
  modified_base (13)..(13): c or u
  modified_base (20)..(20): c or u
  modified_base (27)..(27): c or u
  modified_base (32)..(32): c or u
  modified_base (41)..(41): c or u
  modified_base (47)..(47): c or u
  modified_base (56)..(56): c or u
  modified_base (62)..(62): c or u
  modified_base (71)..(71): c or u
  modified_base (73)..(73): c or u
  modified_base (75)..(75): c or u
  modified_base (77)..(77): c or u
  modified_base (80)..(80): c or u
  modified_base (91)..(91): c or u
  modified_base (98)..(98): c or u
  modified_base (102)..(102): c or u
  modified_base (110)..(110): c or u
  modified_base (117)..(117): c or u
  modified_base (128)..(128): c or u
  modified_base (135)..(135): c or u
  modified_base (137)..(137): c or u
  modified_base (139)..(139): c or u
  modified_base (144)..(144): c or u
  modified_base (146)..(146): c or u
  modified_base (149)..(149): c or u
  modified_base (154)..(154): c or u
  modified_base (158)..(158): c or u
  modified_base (162)..(162): c or u
  modified_base (186)..(186): c or u
  modified_base (193)..(193): c or u
  modified_base (213)..(213): c or u
  modified_base (215)..(215): c or u
  modified_base (223)..(223): c or u
  modified_base (225)..(225): c or u
  modified_base (231)..(231): c or u
  modified_base (234)..(234): c or u
  modified_base (240)..(240): c or u
  modified_base (252)..(252): c or u
  modified_base (255)..(255): c or u
  modified_base (259)..(259): c or u
  modified_base (267)..(267): c or u
  modified_base (269)..(269): c or u
  modified_base (271)..(271): c or u
  modified_base (290)..(290): c or u
  modified_base (292)..(292): c or u
uuunggagaguungggagungutgutngtggngutgutgungutggngtggutggnguaggnggguutggngngngnggngggututgtgnguutggngggngguutgangutgggngguutgttuunggtguangngnggggngnggngggungggngtgnggguagutgaagaaggaguagggngtguaunggutggagguuatgutgtangngutggaungngtuaangungauuungagutgutguunggngtgnguutgggngngnggutgutggauauutgutngngggauauu

SEQ ID NO: 203 - DNA, 300 bp, Artificial Sequence
  Description of Artificial Sequence: Synthetic oligonucleotide
  Description of Combined DNA/RNA Molecule: Synthetic oligonucleotide
  modified_base (37)..(37): c or u
  modified_base (58)..(58): c or u
  modified_base (61)..(61): c or u
  modified_base (85)..(85): c or u
  modified_base (94)..(94): c or u
  modified_base (105)..(105): c or u
  modified_base (111)..(111): c or u
  modified_base (127)..(127): c or u
  modified_base (151)..(151): c or u
  modified_base (192)..(192): c or u
  modified_base (207)..(207): c or u
  modified_base (216)..(216): c or u
  modified_base (235)..(235): c or u
  modified_base (248)..(248): c or u
gaauuagggtagguataguaaagguaauaggtggganggggaguuagggagtggaaangunggaggtuutuaggutggggatuunggagtuutngutuagattungattunggagaagguuaattungggauuutatuuatgtuuuattunggguauuttuutuaaaagtaggggtgggagggguataagunggtuaagtatttuunggguuttunggaguaatuttguutaagngttuatatttaanguattggautgggaaauatttggagatuattgattaagaaatautuaaauut

SEQ ID NO: 204 - DNA, 300 bp, Artificial Sequence
  Description of Artificial Sequence: Synthetic oligonucleotide
  Description of Combined DNA/RNA Molecule: Synthetic oligonucleotide
  modified_base (52)..(52): c or u
  modified_base (65)..(65): c or u
  modified_base (84)..(84): c or u
  modified_base (93)..(93): c or u
  modified_base (108)..(108): c or u
  modified_base (149)..(149): c or u
  modified_base (173)..(173): c or u
  modified_base (189)..(189): c or u
  modified_base (195)..(195): c or u
  modified_base (206)..(206): c or u
  modified_base (215)..(215): c or u
  modified_base (239)..(239): c or u
  modified_base (242)..(242): c or u
  modified_base (263)..(263): c or u
aggtttgagtatttuttaatuaatgatutuuaaatgtttuuuagtuuaatgngttaaatatgaanguttagguaagattgutunggaagguungggaaatauttgaungguttatguuuutuuuauuuutauttttgaggaaggtguunggaatgggauatggatagggtuunggaattgguuttutunggaatnggaatutgagngaggautungggatuuuuaguutgaggauutunggngtttuuautuuutggutuuungtuuuauutgttguutttgutatguutauuutggttu

SEQ ID NO: 205 - DNA, 300 bp, Artificial Sequence
  Description of Artificial Sequence: Synthetic oligonucleotide
  Description of Combined DNA/RNA Molecule: Synthetic oligonucleotide
  modified_base (5)..(5): c or u
  modified_base (8)..(8): c or u
  modified_base (14)..(14): c or u
  modified_base (29)..(29): c or u
  modified_base (33)..(33): c or u
  modified_base (36)..(36): c or u
  modified_base (62)..(62): c or u
  modified_base (64)..(64): c or u
  modified_base (69)..(69): c or u
  modified_base (90)..(90): c or u
  modified_base (96)..(96): c or u
  modified_base (104)..(104): c or u
  modified_base (106)..(106): c or u
  modified_base (109)..(109): c or u
  modified_base (113)..(113): c or u
  modified_base (115)..(115): c or u
  modified_base (120)..(120): c or u
  modified_base (128)..(128): c or u
  modified_base (134)..(134): c or u
  modified_base (150)..(150): c or u
  modified_base (160)..(160): c or u
  modified_base (177)..(177): c or u
  modified_base (184)..(184): c or u
  modified_base (206)..(206): c or u
  modified_base (212)..(212): c or u
  modified_base (220)..(220): c or u
  modified_base (226)..(226): c or u
  modified_base (231)..(231): c or u
  modified_base (251)..(251): c or u
  modified_base (257)..(257): c or u
  modified_base (276)..(276): c or u
  modified_base (282)..(282): c or u
  modified_base (292)..(292): c or u
ttutngtnggtagngututgguuttgggnguungungutttggutatggaggtauagtggungngtuunggggaguutggguutuuttgnggutungaguutungnggnguungnguuungaututunggtuunggutututuuagguunggutgtutunggtuuutuautgauttnguuagunguauuauuuauututttutuunguagangtaaauungaatanguuungguuttggguutaggguutngguutnguutggututauaggattngggggnggggtaggungguagagu

SEQ ID NO: 206 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (18)..(18): c or u
  modified_base (24)..(24): c or u
  modified_base (43)..(43): c or u
  modified_base (49)..(49): c or u
  modified_base (69)..(69): c or u
  modified_base (74)..(74): c or u
  modified_base (80)..(80): c or u
  modified_base (88)..(88): c or u
  modified_base (94)..(94): c or u
  modified_base (116)..(116): c or u
  modified_base (123)..(123): c or u
  modified_base (140)..(140): c or u
  modified_base (150)..(150): c or u
  modified_base (166)..(166): c or u
  modified_base (172)..(172): c or u
  modified_base (180)..(180): c or u
  modified_base (185)..(185): c or u
  modified_base (187)..(187): c or u
  modified_base (191)..(191): c or u
  modified_base (194)..(194): c or u
  modified_base (196)..(196): c or u
  modified_base (204)..(204): c or u
  modified_base (210)..(210): c or u
  modified_base (231)..(231): c or u
  modified_base (236)..(236): c or u
  modified_base (238)..(238): c or u
  modified_base (264)..(264): c or u
  modified_base (267)..(267): c or u
  modified_base (271)..(271): c or u
  modified_base (286)..(286): c or u
  modified_base (292)..(292): c or u
  modified_base (295)..(295): c or u
gututgungguutauuunguuuungaatuutgtagaguuaggngaggungagguuutagguuuaaggunggggngtattngggtttangtutgngggagaaagaggtgggtggtgnggutggngaagtuagtgagggaunggagauagunggguutggagagagungggaunggagagtnggggngngggngungnggaggutnggagunguaaggagguuuaggutuuungggangngguuautgtauutuuataguuaaagnggngggnguuuaagguuagagngutaungangagaa

SEQ ID NO: 207 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (8)..(8): c or u
  modified_base (11)..(11): c or u
  modified_base (19)..(19): c or u
  modified_base (25)..(25): c or u
  modified_base (28)..(28): c or u
  modified_base (34)..(34): c or u
  modified_base (39)..(39): c or u
  modified_base (52)..(52): c or u
  modified_base (54)..(54): c or u
  modified_base (61)..(61): c or u
  modified_base (75)..(75): c or u
  modified_base (78)..(78): c or u
  modified_base (89)..(89): c or u
  modified_base (94)..(94): c or u
  modified_base (98)..(98): c or u
  modified_base (118)..(118): c or u
  modified_base (127)..(127): c or u
  modified_base (139)..(139): c or u
  modified_base (144)..(144): c or u
  modified_base (151)..(151): c or u
  modified_base (154)..(154): c or u
  modified_base (165)..(165): c or u
  modified_base (172)..(172): c or u
  modified_base (176)..(176): c or u
  modified_base (181)..(181): c or u
  modified_base (191)..(191): c or u
  modified_base (207)..(207): c or u
  modified_base (213)..(213): c or u
  modified_base (229)..(229): c or u
  modified_base (235)..(235): c or u
  modified_base (237)..(237): c or u
  modified_base (245)..(245): c or u
  modified_base (254)..(254): c or u
  modified_base (261)..(261): c or u
  modified_base (268)..(268): c or u
  modified_base (277)..(277): c or u
  modified_base (279)..(279): c or u
  modified_base (298)..(298): c or u
nguauaungangguutuungggttnggnggggangauungagutaggaguungngggggungtgggagutgutungungaggtggauunggggnguunguauuuutuauuttutttungtggggtungggguuaggganguagnggggganggnggguatuagunggguagnguungagungtuuutggungggtuuuuauauutgngtgutnggguatuuuuagggtngggggngnggtgaatngtggtuuunguaguungggguunguuagguungnggagtuaguuuauuutggnga

SEQ ID NO: 208 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (21)..(21): c or u
  modified_base (23)..(23): c or u
  modified_base (32)..(32): c or u
  modified_base (39)..(39): c or u
  modified_base (46)..(46): c or u
  modified_base (55)..(55): c or u
  modified_base (63)..(63): c or u
  modified_base (65)..(65): c or u
  modified_base (71)..(71): c or u
  modified_base (87)..(87): c or u
  modified_base (93)..(93): c or u
  modified_base (109)..(109): c or u
  modified_base (119)..(119): c or u
  modified_base (124)..(124): c or u
  modified_base (128)..(128): c or u
  modified_base (135)..(135): c or u
  modified_base (146)..(146): c or u
  modified_base (149)..(149): c or u
  modified_base (156)..(156): c or u
  modified_base (161)..(161): c or u
  modified_base (173)..(173): c or u
  modified_base (182)..(182): c or u
  modified_base (202)..(202): c or u
  modified_base (206)..(206): c or u
  modified_base (211)..(211): c or u
  modified_base (222)..(222): c or u
  modified_base (225)..(225): c or u
  modified_base (239)..(239): c or u
  modified_base (246)..(246): c or u
  modified_base (248)..(248): c or u
  modified_base (261)..(261): c or u
  modified_base (266)..(266): c or u
  modified_base (272)..(272): c or u
  modified_base (275)..(275): c or u
  modified_base (281)..(281): c or u
  modified_base (289)..(289): c or u
  modified_base (292)..(292): c or u
  modified_base (299)..(299): c or u
tnguuagggtgggutgautungnggguutggnggguuungggutgnggggauuangattuaungnguuuungauuutggggatguungaguanguaggtgtggggauungguuaggganggutngggngutguunggutgatguungungtuuuungutgngtuuutgguuunggauuuuanggaaagaaggtgaggggtgngggnguuungggtuuauutnggnggaguagutuuuangguuuungngggutuutagutngggtngtuuungungaauungggaggungtnggtgtgng

SEQ ID NO: 209 - DNA, 300 bp, Artificial Sequence
  Description of Artificial Sequence: Synthetic oligonucleotide
  Description of Combined DNA/RNA Molecule: Synthetic oligonucleotide
  modified_base (16)..(16): c or u
  modified_base (18)..(18): c or u
  modified_base (26)..(26): c or u
  modified_base (35)..(35): c or u
  modified_base (39)..(39): c or u
  modified_base (46)..(46): c or u
  modified_base (48)..(48): c or u
  modified_base (54)..(54): c or u
  modified_base (58)..(58): c or u
  modified_base (69)..(69): c or u
  modified_base (71)..(71): c or u
  modified_base (82)..(82): c or u
  modified_base (87)..(87): c or u
  modified_base (91)..(91): c or u
  modified_base (101)..(101): c or u
  modified_base (103)..(103): c or u
  modified_base (105)..(105): c or u
  modified_base (114)..(114): c or u
  modified_base (118)..(118): c or u
  modified_base (124)..(124): c or u
  modified_base (128)..(128): c or u
  modified_base (133)..(133): c or u
  modified_base (135)..(135): c or u
  modified_base (139)..(139): c or u
  modified_base (148)..(148): c or u
  modified_base (150)..(150): c or u
  modified_base (162)..(162): c or u
  modified_base (173)..(173): c or u
  modified_base (177)..(177): c or u
  modified_base (181)..(181): c or u
  modified_base (194)..(194): c or u
  modified_base (201)..(201): c or u
  modified_base (203)..(203): c or u
  modified_base (219)..(219): c or u
  modified_base (225)..(225): c or u
  modified_base (229)..(229): c or u
  modified_base (237)..(237): c or u
  modified_base (245)..(245): c or u
  modified_base (254)..(254): c or u
  modified_base (261)..(261): c or u
  modified_base (263)..(263): c or u
  modified_base (272)..(272): c or u
  modified_base (275)..(275): c or u
  modified_base (291)..(291): c or u
  modified_base (294)..(294): c or u
gauuaaaaggagutungnguuaggunggaggutgnguungtuautngnggtuunggungggtuuutggngngtagtuaggunguaunguungaguuuuaungngnguuuauuunggungggtgngtunggutngnggungtuuutuungngauutgtgguunggggutgutgngggnguunggggaagagaggngggggungngggggguaggaggagnggutgnggungguauagnguuagggngagtgaggngggtggngngggggaggnggnggagtaaagagaggungunggutgg

SEQ ID NO: 210 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (9)..(9): c or u
  modified_base (25)..(25): c or u
  modified_base (28)..(28): c or u
  modified_base (37)..(37): c or u
  modified_base (39)..(39): c or u
  modified_base (46)..(46): c or u
  modified_base (55)..(55): c or u
  modified_base (63)..(63): c or u
  modified_base (71)..(71): c or u
  modified_base (75)..(75): c or u
  modified_base (81)..(81): c or u
  modified_base (97)..(97): c or u
  modified_base (99)..(99): c or u
  modified_base (106)..(106): c or u
  modified_base (119)..(119): c or u
  modified_base (123)..(123): c or u
  modified_base (127)..(127): c or u
  modified_base (138)..(138): c or u
  modified_base (150)..(150): c or u
  modified_base (152)..(152): c or u
  modified_base (161)..(161): c or u
  modified_base (165)..(165): c or u
  modified_base (167)..(167): c or u
  modified_base (172)..(172): c or u
  modified_base (176)..(176): c or u
  modified_base (182)..(182): c or u
  modified_base (186)..(186): c or u
  modified_base (195)..(195): c or u
  modified_base (197)..(197): c or u
  modified_base (199)..(199): c or u
  modified_base (209)..(209): c or u
  modified_base (213)..(213): c or u
  modified_base (218)..(218): c or u
  modified_base (229)..(229): c or u
  modified_base (231)..(231): c or u
  modified_base (242)..(242): c or u
  modified_base (246)..(246): c or u
  modified_base (252)..(252): c or u
  modified_base (254)..(254): c or u
  modified_base (261)..(261): c or u
  modified_base (265)..(265): c or u
  modified_base (274)..(274): c or u
  modified_base (282)..(282): c or u
  modified_base (284)..(284): c or u
uuagunggngguutututttautungunguutuuuungnguuauunguutuautnguuutggngutgtgunggunguagungutuutuutguuuuungngguuuunguutututtuuungggnguunguaguaguuunggguuauaggtngngggaggganggungngagungganguauunggunggggtgggngngnggtggggutngggnggtgngguutgautangnguuagggauunggungggaungngagtgangggnguaguutungguutggngnggagutuuttttggtu

SEQ ID NO: 211 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (13)..(13): c or u
  modified_base (18)..(18): c or u
  modified_base (22)..(22): c or u
  modified_base (39)..(39): c or u
  modified_base (55)..(55): c or u
  modified_base (59)..(59): c or u
  modified_base (63)..(63): c or u
  modified_base (76)..(76): c or u
  modified_base (80)..(80): c or u
  modified_base (85)..(85): c or u
  modified_base (89)..(89): c or u
  modified_base (94)..(94): c or u
  modified_base (103)..(103): c or u
  modified_base (119)..(119): c or u
  modified_base (126)..(126): c or u
  modified_base (132)..(132): c or u
  modified_base (135)..(135): c or u
  modified_base (150)..(150): c or u
  modified_base (157)..(157): c or u
  modified_base (184)..(184): c or u
  modified_base (191)..(191): c or u
  modified_base (198)..(198): c or u
  modified_base (202)..(202): c or u
  modified_base (204)..(204): c or u
  modified_base (208)..(208): c or u
  modified_base (214)..(214): c or u
gungguauutgungutunguungggattagggagutuungguttgtggggggtgngggnggunggtggtuuagutnguunguuunggungagangutggguungguuuuuauaggutgnguutgangggaunggngggagguutttgttnguaguunggagguuuuaggutuuaaauuauautngggutgnggggagngagngngggngttgungutaattgutgutaattttgttuuattaautttatttaututtgaauuuuttaattgttttuuauttatttttagtaattttataa

SEQ ID NO: 212 - DNA, 300 bp, Artificial Sequence
  Description of Artificial Sequence: Synthetic oligonucleotide
  Description of Combined DNA/RNA Molecule: Synthetic oligonucleotide
  modified_base (86)..(86): c or u
  modified_base (92)..(92): c or u
  modified_base (96)..(96): c or u
  modified_base (98)..(98): c or u
  modified_base (102)..(102): c or u
  modified_base (109)..(109): c or u
  modified_base (116)..(116): c or u
  modified_base (143)..(143): c or u
  modified_base (150)..(150): c or u
  modified_base (165)..(165): c or u
  modified_base (168)..(168): c or u
  modified_base (174)..(174): c or u
  modified_base (181)..(181): c or u
  modified_base (197)..(197): c or u
  modified_base (206)..(206): c or u
  modified_base (211)..(211): c or u
  modified_base (215)..(215): c or u
  modified_base (220)..(220): c or u
  modified_base (224)..(224): c or u
  modified_base (237)..(237): c or u
  modified_base (241)..(241): c or u
  modified_base (245)..(245): c or u
  modified_base (261)..(261): c or u
  modified_base (278)..(278): c or u
  modified_base (282)..(282): c or u
  modified_base (287)..(287): c or u
  modified_base (297)..(297): c or u
ttataaaattautaaaaataagtggaaaauaattaaggggttuaagagtaaataaagttaatggaauaaaattaguaguaattagngguaanguungngutngutuuunguaguungagtgtggtttggaguutgggguutungggutgngaauaaagguutuungunggtuungtuaggnguaguutgtgggggunggguuuagngtutnggunggggngggngagutggauuaunggunguunguauuuuuuauaagungggagutuuutaatuungggnggagngguaggtgunggu

SEQ ID NO: 213 - DNA, 300 bp, Artificial Sequence
  Description of Artificial Sequence: Synthetic oligonucleotide
  Description of Combined DNA/RNA Molecule: Synthetic oligonucleotide
  modified_base (8)..(8): c or u
  modified_base (26)..(26): c or u
  modified_base (35)..(35): c or u
  modified_base (48)..(48): c or u
  modified_base (56)..(56): c or u
  modified_base (59)..(59): c or u
  modified_base (61)..(61): c or u
  modified_base (82)..(82): c or u
  modified_base (105)..(105): c or u
  modified_base (108)..(108): c or u
  modified_base (116)..(116): c or u
  modified_base (137)..(137): c or u
  modified_base (139)..(139): c or u
  modified_base (151)..(151): c or u
  modified_base (160)..(160): c or u
  modified_base (170)..(170): c or u
  modified_base (176)..(176): c or u
  modified_base (188)..(188): c or u
  modified_base (197)..(197): c or u
  modified_base (203)..(203): c or u
  modified_base (214)..(214): c or u
  modified_base (222)..(222): c or u
  modified_base (228)..(228): c or u
  modified_base (230)..(230): c or u
  modified_base (236)..(236): c or u
  modified_base (238)..(238): c or u
  modified_base (248)..(248): c or u
  modified_base (262)..(262): c or u
  modified_base (267)..(267): c or u
  modified_base (272)..(272): c or u
  modified_base (286)..(286): c or u
tuaguaunggggauagutuutguutnguuaauttngguagututtutngatgtutngungngggutgtguutuauaggutangggaggggagagtgtutuuuuangunggggtuungguututgggttttagggagngngaatgggtutungauaguaangggaguagunggtggnguutuaggutgnggtgguaangaguungautguautanggutttgngggaungnguuagngnggaggagaungaguuuatutuagngggungggunggauuuaggtgagngguuutggutuuuu

SEQ ID NO: 214 - DNA, 300 bp, Artificial Sequence
  Description of Artificial Sequence: Synthetic oligonucleotide
  Description of Combined DNA/RNA Molecule: Synthetic oligonucleotide
  modified_base (14)..(14): c or u
  modified_base (28)..(28): c or u
  modified_base (33)..(33): c or u
  modified_base (38)..(38): c or u
  modified_base (52)..(52): c or u
  modified_base (62)..(62): c or u
  modified_base (64)..(64): c or u
  modified_base (70)..(70): c or u
  modified_base (72)..(72): c or u
  modified_base (78)..(78): c or u
  modified_base (86)..(86): c or u
  modified_base (97)..(97): c or u
  modified_base (103)..(103): c or u
  modified_base (112)..(112): c or u
  modified_base (124)..(124): c or u
  modified_base (130)..(130): c or u
  modified_base (140)..(140): c or u
  modified_base (149)..(149): c or u
  modified_base (161)..(161): c or u
  modified_base (163)..(163): c or u
  modified_base (184)..(184): c or u
  modified_base (192)..(192): c or u
  modified_base (195)..(195): c or u
  modified_base (218)..(218): c or u
  modified_base (239)..(239): c or u
  modified_base (241)..(241): c or u
  modified_base (244)..(244): c or u
  modified_base (252)..(252): c or u
  modified_base (265)..(265): c or u
  modified_base (274)..(274): c or u
  modified_base (292)..(292): c or u
ggggaguuagggungutuauutgggtungguungguungutgagatgggutnggtutuutungngutggngnggtuunguaaagungtagtguagtngggutngttguuaunguaguutgaggnguuaunggutgutuungttgutgtnggagauuuattngngutuuutaaaauuuagaggungggauuunggngtggggagauaututuuuutuungtaguutgtgagguauaguungnggngagauatngagaagagutgungaagttggngagguaggagutgtuuunggtgutga

SEQ ID NO: 215 - DNA, 300 bp, Artificial Sequence
  Description of Artificial Sequence: Synthetic oligonucleotide
  Description of Combined DNA/RNA Molecule: Synthetic oligonucleotide
  modified_base (7)..(7): c or u
  modified_base (14)..(14): c or u
  modified_base (27)..(27): c or u
  modified_base (32)..(32): c or u
  modified_base (43)..(43): c or u
  modified_base (46)..(46): c or u
  modified_base (50)..(50): c or u
  modified_base (57)..(57): c or u
  modified_base (69)..(69): c or u
  modified_base (92)..(92): c or u
  modified_base (94)..(94): c or u
  modified_base (100)..(100): c or u
  modified_base (105)..(105): c or u
  modified_base (114)..(114): c or u
  modified_base (120)..(120): c or u
  modified_base (123)..(123): c or u
  modified_base (132)..(132): c or u
  modified_base (135)..(135): c or u
  modified_base (141)..(141): c or u
  modified_base (146)..(146): c or u
  modified_base (155)..(155): c or u
  modified_base (157)..(157): c or u
  modified_base (159)..(159): c or u
  modified_base (161)..(161): c or u
  modified_base (164)..(164): c or u
  modified_base (175)..(175): c or u
  modified_base (185)..(185): c or u
  modified_base (188)..(188): c or u
  modified_base (193)..(193): c or u
  modified_base (198)..(198): c or u
  modified_base (200)..(200): c or u
  modified_base (209)..(209): c or u
  modified_base (211)..(211): c or u
  modified_base (240)..(240): c or u
  modified_base (250)..(250): c or u
  modified_base (259)..(259): c or u
  modified_base (273)..(273): c or u
  modified_base (275)..(275): c or u
  modified_base (277)..(277): c or u
  modified_base (294)..(294): c or u
ttuutungagguunguagggagggggnggtgnggaatggatgngungagnggguagngutuaguututngutuauauuuuuaguagguagungngtuuungtgungguatuutngutgungunggutuuutnggnguuuungggungutuuuuangngngngungggauutguangaguuuuutngtngautnggagngngatutgggngngtguutuuutgtuuttgtuututgututngtutggggangtgtguuunguauuuuutguaungngngutuututauuuutuungutuuu

SEQ ID NO: 216 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (23)..(23): c or u
  modified_base (25)..(25): c or u
  modified_base (27)..(27): c or u
  modified_base (41)..(41): c or u
  modified_base (50)..(50): c or u
  modified_base (60)..(60): c or u
  modified_base (89)..(89): c or u
  modified_base (91)..(91): c or u
  modified_base (100)..(100): c or u
  modified_base (102)..(102): c or u
  modified_base (107)..(107): c or u
  modified_base (112)..(112): c or u
  modified_base (115)..(115): c or u
  modified_base (125)..(125): c or u
  modified_base (136)..(136): c or u
  modified_base (139)..(139): c or u
  modified_base (141)..(141): c or u
  modified_base (143)..(143): c or u
  modified_base (145)..(145): c or u
  modified_base (154)..(154): c or u
  modified_base (159)..(159): c or u
  modified_base (165)..(165): c or u
  modified_base (168)..(168): c or u
  modified_base (177)..(177): c or u
  modified_base (180)..(180): c or u
  modified_base (186)..(186): c or u
  modified_base (195)..(195): c or u
  modified_base (200)..(200): c or u
  modified_base (206)..(206): c or u
  modified_base (208)..(208): c or u
  modified_base (231)..(231): c or u
  modified_base (243)..(243): c or u
  modified_base (250)..(250): c or u
  modified_base (254)..(254): c or u
  modified_base (257)..(257): c or u
  modified_base (268)..(268): c or u
  modified_base (273)..(273): c or u
  modified_base (286)..(286): c or u
  modified_base (293)..(293): c or u
gggagngggaggggtagaggagngngnggtguagggggtgngggguauangtuuuuagangagaguagaggauaaggauagggagguangnguuuagatngngutungagtngangagggggutngtguaggtuunggngngngngtggggagngguungggggngungagggagunggngguagngaggatgungguanggggangnggutguutgutgggggtgtgagngagaggutgagngutguungutnggnguatuuattunguaunguuuuutuuutgnggguutnggaggaa

SEQ ID NO: 217 - DNA, 300 bp, Artificial Sequence
  Description of Artificial Sequence: Synthetic oligonucleotide
  Description of Combined DNA/RNA Molecule: Synthetic oligonucleotide
  modified_base (11)..(11): c or u
  modified_base (17)..(17): c or u
  modified_base (22)..(22): c or u
  modified_base (38)..(38): c or u
  modified_base (53)..(53): c or u
  modified_base (55)..(55): c or u
  modified_base (112)..(112): c or u
  modified_base (115)..(115): c or u
  modified_base (120)..(120): c or u
  modified_base (122)..(122): c or u
  modified_base (136)..(136): c or u
  modified_base (143)..(143): c or u
  modified_base (149)..(149): c or u
  modified_base (152)..(152): c or u
  modified_base (175)..(175): c or u
  modified_base (179)..(179): c or u
  modified_base (191)..(191): c or u
  modified_base (193)..(193): c or u
  modified_base (204)..(204): c or u
  modified_base (223)..(223): c or u
  modified_base (230)..(230): c or u
  modified_base (256)..(256): c or u
  modified_base (258)..(258): c or u
  modified_base (267)..(267): c or u
  modified_base (272)..(272): c or u
  modified_base (281)..(281): c or u
  modified_base (297)..(297): c or u
  modified_base (299)..(299): c or u
aaggggagggnggggungauunggauuutuuagggaanguuuttgagtaautngnguauttgggauuuattuuuauutaggauuataggutuaagatgguutggtggatgungungguangnguututuututggngggaaungaaggngunggtaggttttuauauttguagungatnggutaagagaangngggattuagungagaaguuautgggaguungaggagnggaguagagguauuuagguaguutgngnggagaaatnggatnggutaggangguutguaguuuutgngng

SEQ ID NO: 218 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (3)..(3): c or u
  modified_base (19)..(19): c or u
  modified_base (28)..(28): c or u
  modified_base (33)..(33): c or u
  modified_base (42)..(42): c or u
  modified_base (44)..(44): c or u
  modified_base (70)..(70): c or u
  modified_base (77)..(77): c or u
  modified_base (96)..(96): c or u
  modified_base (107)..(107): c or u
  modified_base (109)..(109): c or u
  modified_base (121)..(121): c or u
  modified_base (125)..(125): c or u
  modified_base (148)..(148): c or u
  modified_base (151)..(151): c or u
  modified_base (157)..(157): c or u
  modified_base (164)..(164): c or u
  modified_base (178)..(178): c or u
  modified_base (180)..(180): c or u
  modified_base (185)..(185): c or u
  modified_base (188)..(188): c or u
  modified_base (245)..(245): c or u
  modified_base (247)..(247): c or u
  modified_base (262)..(262): c or u
  modified_base (278)..(278): c or u
  modified_base (283)..(283): c or u
  modified_base (289)..(289): c or u
ngnguaggggutguaggungtuutagungatungatttutungnguaggutguutgggtguututgutungutuutngggutuuuagtgguttutnggutgaatuungngttututtagungatnggutguaagtgtgaaaauutaunggnguuttnggttuunguuagaggagaggngngtgunggngguatuuauuagguuatuttgaguutatggtuutaggtgggaatgggtuuuaagtgngngagttautuaagggngttuuutggagggtungggtngguuunguuutuuuutt

SEQ ID NO: 219 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (30)..(30): c or u
  modified_base (37)..(37): c or u
  modified_base (44)..(44): c or u
  modified_base (72)..(72): c or u
  modified_base (75)..(75): c or u
  modified_base (77)..(77): c or u
  modified_base (88)..(88): c or u
  modified_base (91)..(91): c or u
  modified_base (98)..(98): c or u
  modified_base (102)..(102): c or u
  modified_base (104)..(104): c or u
  modified_base (116)..(116): c or u
  modified_base (124)..(124): c or u
  modified_base (150)..(150): c or u
  modified_base (155)..(155): c or u
  modified_base (197)..(197): c or u
  modified_base (225)..(225): c or u
  modified_base (227)..(227): c or u
  modified_base (239)..(239): c or u
  modified_base (241)..(241): c or u
  modified_base (249)..(249): c or u
  modified_base (263)..(263): c or u
  modified_base (269)..(269): c or u
  modified_base (275)..(275): c or u
  modified_base (281)..(281): c or u
  modified_base (283)..(283): c or u
tgtggnggggguttggagutgutgagagungagaggnguagagnguaagutgguaggutgggutgutatuunggngnguagatguuungunguuagtngagngngaauatututunggaauatngatutatuauutuuutttaaggauunggaungggaaatttuuattttutgttttgggaataagaaataaaagngauuaagututtguuutaatttuuuuungnggguuuttuuangngggutggngggatuagaaggangggtungagutngggggngnggggttuutgtgaautu

SEQ ID NO: 220 - DNA, 300 bp, Artificial Sequence
  Description of Artificial Sequence: Synthetic oligonucleotide
  Description of Combined DNA/RNA Molecule: Synthetic oligonucleotide
  modified_base (17)..(17): c or u
  modified_base (19)..(19): c or u
  modified_base (25)..(25): c or u
  modified_base (31)..(31): c or u
  modified_base (37)..(37): c or u
  modified_base (51)..(51): c or u
  modified_base (59)..(59): c or u
  modified_base (61)..(61): c or u
  modified_base (73)..(73): c or u
  modified_base (75)..(75): c or u
  modified_base (103)..(103): c or u
  modified_base (145)..(145): c or u
  modified_base (150)..(150): c or u
  modified_base (176)..(176): c or u
  modified_base (184)..(184): c or u
  modified_base (196)..(196): c or u
  modified_base (198)..(198): c or u
  modified_base (202)..(202): c or u
  modified_base (209)..(209): c or u
  modified_base (212)..(212): c or u
  modified_base (223)..(223): c or u
  modified_base (225)..(225): c or u
  modified_base (228)..(228): c or u
  modified_base (256)..(256): c or u
  modified_base (263)..(263): c or u
  modified_base (270)..(270): c or u
  modified_base (294)..(294): c or u
gagttuauaggaauuungnguuuungagutnggauungtuuttutgatuunguuaguungngtggaaggguungnggggggaaattaggguaagaguttggtnguttttatttuttattuuuaaaauagaaaatggaaatttuunggtungggtuuttaaagggaggtgatagatngatgttunggagagatgttngngutngautggnggngggguatutgngngungggataguaguuuaguutguuaguttgngututgnguututnggututuaguagutuuaaguuuunguuaua

SEQ ID NO: 221 - DNA, 300 bp, Artificial Sequence
  Description of Artificial Sequence: Synthetic oligonucleotide
  Description of Combined DNA/RNA Molecule: Synthetic oligonucleotide
  modified_base (17)..(17): c or u
  modified_base (68)..(68): c or u
  modified_base (95)..(95): c or u
  modified_base (122)..(122): c or u
  modified_base (140)..(140): c or u
  modified_base (150)..(150): c or u
  modified_base (153)..(153): c or u
  modified_base (174)..(174): c or u
  modified_base (181)..(181): c or u
  modified_base (197)..(197): c or u
  modified_base (230)..(230): c or u
  modified_base (246)..(246): c or u
  modified_base (258)..(258): c or u
  modified_base (264)..(264): c or u
  modified_base (278)..(278): c or u
  modified_base (282)..(282): c or u
  modified_base (289)..(289): c or u
  modified_base (299)..(299): c or u
uaguuuttggutttuunguttuagguaaaatuttuuutuuttuututtttttutgggguuttuuuuangauuuututtuutaguuuttutgatungtuuuutgatguatgautgggguuaunggaggggutgauuutuunggagaguuungtnggtuutggtggtuttgggaunggagagngauagatgtggaaaungagguuuutuagtgaagagutguuagggtggtnguuttagaguaaaggngttuutuattunguutgnguagutguuuutunguunggutgunguuuuaguung

SEQ ID NO: 222 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (11)..(11): c or u
  modified_base (18)..(18): c or u
  modified_base (22)..(22): c or u
  modified_base (36)..(36): c or u
  modified_base (42)..(42): c or u
  modified_base (54)..(54): c or u
  modified_base (70)..(70): c or u
  modified_base (103)..(103): c or u
  modified_base (119)..(119): c or u
  modified_base (126)..(126): c or u
  modified_base (147)..(147): c or u
  modified_base (150)..(150): c or u
  modified_base (160)..(160): c or u
  modified_base (178)..(178): c or u
  modified_base (205)..(205): c or u
  modified_base (232)..(232): c or u
  modified_base (283)..(283): c or u
ngggutggggngguagungggnggagggguagutgnguaggnggaatgaggaanguutttgututaaggngauuauuutgguagututtuautgagggguutnggtttuuauatutgtngututunggtuuuaagauuauuaggaunganggggututungggagggtuaguuuutunggtgguuuuagtuatguatuagggganggatuagaagggutaggaagaggggtngtggggaagguuuuagaaaaaagaggaaggagggaagattttguutgaagngggaaaguuaagggutg

SEQ ID NO: 223 - DNA, 300 bp, Artificial Sequence
  Description of Artificial Sequence: Synthetic oligonucleotide
  Description of Combined DNA/RNA Molecule: Synthetic oligonucleotide
  modified_base (27)..(27): c or u
  modified_base (29)..(29): c or u
  modified_base (59)..(59): c or u
  modified_base (77)..(77): c or u
  modified_base (92)..(92): c or u
  modified_base (97)..(97): c or u
  modified_base (104)..(104): c or u
  modified_base (113)..(113): c or u
  modified_base (120)..(120): c or u
  modified_base (129)..(129): c or u
  modified_base (139)..(139): c or u
  modified_base (142)..(142): c or u
  modified_base (145)..(145): c or u
  modified_base (150)..(150): c or u
  modified_base (157)..(157): c or u
  modified_base (159)..(159): c or u
  modified_base (169)..(169): c or u
  modified_base (174)..(174): c or u
  modified_base (176)..(176): c or u
  modified_base (187)..(187): c or u
  modified_base (212)..(212): c or u
  modified_base (226)..(226): c or u
  modified_base (267)..(267): c or u
  modified_base (269)..(269): c or u
  modified_base (271)..(271): c or u
  modified_base (289)..(289): c or u
  modified_base (292)..(292): c or u
  modified_base (299)..(299): c or u
gggaaaggggggagagggagaggaggngnggggtgggggaggggagtgaguagggagungggagagggaggaggggngggaauuaggggagngguungaauuungtttggtunggauuunguaguuaungutgggtutngungungggtnguuuttngngtggagatunggtungnguuuuutuuunggtutuutuuuutuuuutuuuutunguuuuuutuuutungguuuauauaguututtuuagaaagaagtuaututagagungngngauuuaguuuuagagtungunggggtung

SEQ ID NO: 224 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (8)..(8): c or u
  modified_base (11)..(11): c or u
  modified_base (29)..(29): c or u
  modified_base (31)..(31): c or u
  modified_base (33)..(33): c or u
  modified_base (74)..(74): c or u
  modified_base (88)..(88): c or u
  modified_base (113)..(113): c or u
  modified_base (124)..(124): c or u
  modified_base (126)..(126): c or u
  modified_base (131)..(131): c or u
  modified_base (141)..(141): c or u
  modified_base (143)..(143): c or u
  modified_base (150)..(150): c or u
  modified_base (155)..(155): c or u
  modified_base (158)..(158): c or u
  modified_base (161)..(161): c or u
  modified_base (171)..(171): c or u
  modified_base (180)..(180): c or u
  modified_base (187)..(187): c or u
  modified_base (196)..(196): c or u
  modified_base (203)..(203): c or u
  modified_base (208)..(208): c or u
  modified_base (223)..(223): c or u
  modified_base (241)..(241): c or u
  modified_base (271)..(271): c or u
  modified_base (273)..(273): c or u
nggauuunggnggaututggggutgggtngngnggututagagtgauttutttutggaagaggutgtgtgggunggagggaggggggnggaggggaggggaggggaggagaunggggagggggngnggaunggatutuuangngaagggngauunggnggngagauuuagnggtggutgnggggtunggauuaaanggggttngggungutuuuutggttuunguuuutuutuuututuunggutuuutgutuautuuuutuuuuuauuungnguutuututuuututuuuuuutttuuu

SEQ ID NO: 225 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (6)..(6): c or u
  modified_base (8)..(8): c or u
  modified_base (19)..(19): c or u
  modified_base (44)..(44): c or u
  modified_base (58)..(58): c or u
  modified_base (99)..(99): c or u
  modified_base (101)..(101): c or u
  modified_base (103)..(103): c or u
  modified_base (121)..(121): c or u
  modified_base (124)..(124): c or u
  modified_base (131)..(131): c or u
  modified_base (138)..(138): c or u
  modified_base (149)..(149): c or u
  modified_base (151)..(151): c or u
  modified_base (161)..(161): c or u
  modified_base (171)..(171): c or u
  modified_base (182)..(182): c or u
  modified_base (188)..(188): c or u
  modified_base (200)..(200): c or u
  modified_base (203)..(203): c or u
  modified_base (209)..(209): c or u
  modified_base (211)..(211): c or u
  modified_base (223)..(223): c or u
  modified_base (228)..(228): c or u
  modified_base (239)..(239): c or u
  modified_base (246)..(246): c or u
  modified_base (248)..(248): c or u
  modified_base (250)..(250): c or u
  modified_base (254)..(254): c or u
  modified_base (266)..(266): c or u
  modified_base (274)..(274): c or u
  modified_base (283)..(283): c or u
nggtungnguuuuutuuunggtutuutuuuutuuuutuuuutunguuuuuutuuutungguuuauauaguututtuuagaaagaagtuaututagagungngngauuuaguuuuagagtungunggggtunguuuaungggtutuutgngnguuuutuuunguuuutuuunggguauaguungttuangaaauutaaggngungguuangnguuauutuuuungggunggggtutuutnggtuuungngngggngutggttutuungggtgggngguaguuunguuutgtguuutuutgg

SEQ ID NO: 226 - DNA, 300 bp, Artificial Sequence
  Description of Artificial Sequence: Synthetic oligonucleotide
  Description of Combined DNA/RNA Molecule: Synthetic oligonucleotide
  modified_base (17)..(17): c or u
  modified_base (26)..(26): c or u
  modified_base (34)..(34): c or u
  modified_base (46)..(46): c or u
  modified_base (50)..(50): c or u
  modified_base (52)..(52): c or u
  modified_base (54)..(54): c or u
  modified_base (61)..(61): c or u
  modified_base (72)..(72): c or u
  modified_base (77)..(77): c or u
  modified_base (89)..(89): c or u
  modified_base (91)..(91): c or u
  modified_base (97)..(97): c or u
  modified_base (100)..(100): c or u
  modified_base (112)..(112): c or u
  modified_base (118)..(118): c or u
  modified_base (129)..(129): c or u
  modified_base (139)..(139): c or u
  modified_base (149)..(149): c or u
  modified_base (151)..(151): c or u
  modified_base (162)..(162): c or u
  modified_base (169)..(169): c or u
  modified_base (176)..(176): c or u
  modified_base (179)..(179): c or u
  modified_base (197)..(197): c or u
  modified_base (199)..(199): c or u
  modified_base (201)..(201): c or u
  modified_base (242)..(242): c or u
  modified_base (256)..(256): c or u
  modified_base (281)..(281): c or u
  modified_base (292)..(292): c or u
  modified_base (294)..(294): c or u
  modified_base (299)..(299): c or u
uuaggaggguauagggnggggutgunguuuauungggagaauuagnguungngnggggaungaggagauuungguungggggaggtggngngtggunggnguuttaggtttngtgaangggutgtguunggggaggggnggggaggggngnguaggagauunggtgggnggauuunggnggaututggggutgggtngngnggututagagtgauttutttutggaagaggutgtgtgggunggagggaggggggnggaggggaggggaggggaggagaunggggagggggngnggaung

SEQ ID NO: 227 - DNA, 300 bp, Artificial Sequence
  Description of Artificial Sequence: Synthetic oligonucleotide
  Description of Combined DNA/RNA Molecule: Synthetic oligonucleotide
  modified_base (2)..(2): c or u
  modified_base (6)..(6): c or u
  modified_base (9)..(9): c or u
  modified_base (16)..(16): c or u
  modified_base (27)..(27): c or u
  modified_base (38)..(38): c or u
  modified_base (50)..(50): c or u
  modified_base (65)..(65): c or u
  modified_base (68)..(68): c or u
  modified_base (72)..(72): c or u
  modified_base (74)..(74): c or u
  modified_base (78)..(78): c or u
  modified_base (86)..(86): c or u
  modified_base (135)..(135): c or u
  modified_base (150)..(150): c or u
  modified_base (153)..(153): c or u
  modified_base (157)..(157): c or u
  modified_base (167)..(167): c or u
  modified_base (176)..(176): c or u
  modified_base (189)..(189): c or u
  modified_base (204)..(204): c or u
  modified_base (212)..(212): c or u
  modified_base (214)..(214): c or u
  modified_base (216)..(216): c or u
  modified_base (230)..(230): c or u
  modified_base (239)..(239): c or u
  modified_base (249)..(249): c or u
  modified_base (263)..(263): c or u
  modified_base (265)..(265): c or u
  modified_base (270)..(270): c or u
  modified_base (272)..(272): c or u
  modified_base (275)..(275): c or u
  modified_base (277)..(277): c or u
  modified_base (291)..(291): c or u
gnggtnggnguuuuangutuuutgaanguuuuuuaggngguauuagtgunggguagagtuuuutnggnggungngggngtuaaatngauauutgautuuauagutuuuttuuututuututtuttuuauutuuungggggtuuagguaungungtgngtuuautuunggtutuuangguttagguaganggagtgggggautunggggauungngngtuututuutuutngguuutggngggaggagungggutggggtttungngggungnggngngttttagggutgunggggautgu

SEQ ID NO: 228 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (23)..(23): c or u
  modified_base (25)..(25): c or u
  modified_base (28)..(28): c or u
  modified_base (30)..(30): c or u
  modified_base (35)..(35): c or u
  modified_base (37)..(37): c or u
  modified_base (51)..(51): c or u
  modified_base (61)..(61): c or u
  modified_base (70)..(70): c or u
  modified_base (84)..(84): c or u
  modified_base (86)..(86): c or u
  modified_base (88)..(88): c or u
  modified_base (96)..(96): c or u
  modified_base (111)..(111): c or u
  modified_base (124)..(124): c or u
  modified_base (133)..(133): c or u
  modified_base (143)..(143): c or u
  modified_base (147)..(147): c or u
  modified_base (150)..(150): c or u
  modified_base (165)..(165): c or u
  modified_base (214)..(214): c or u
  modified_base (222)..(222): c or u
  modified_base (226)..(226): c or u
  modified_base (228)..(228): c or u
  modified_base (232)..(232): c or u
  modified_base (235)..(235): c or u
  modified_base (250)..(250): c or u
  modified_base (262)..(262): c or u
  modified_base (273)..(273): c or u
  modified_base (284)..(284): c or u
  modified_base (291)..(291): c or u
  modified_base (294)..(294): c or u
  modified_base (298)..(298): c or u
guagtuuungguaguuutaaaangngungngguungnggaaauuuuaguunggutuutuunguuagggungaggaggagaggangngngggtuuunggagtuuuuuautungtutguutaagungtggagaungggagtgganguanggnggtguutggauuuunggggaggtggaagaagaggagagggaagggagutgtggagtuaggtgtngatttganguungnggungungaggggaututguungguautggtgunguutggggggngttuagggagngtggggngungaungu

SEQ ID NO: 229 - DNA, 300 bp, Artificial Sequence
  Description of Artificial Sequence: Synthetic oligonucleotide
  Description of Combined DNA/RNA Molecule: Synthetic oligonucleotide
  modified_base (10)..(10): c or u
  modified_base (37)..(37): c or u
  modified_base (43)..(43): c or u
  modified_base (45)..(45): c or u
  modified_base (54)..(54): c or u
  modified_base (58)..(58): c or u
  modified_base (64)..(64): c or u
  modified_base (69)..(69): c or u
  modified_base (73)..(73): c or u
  modified_base (82)..(82): c or u
  modified_base (91)..(91): c or u
  modified_base (93)..(93): c or u
  modified_base (102)..(102): c or u
  modified_base (109)..(109): c or u
  modified_base (129)..(129): c or u
  modified_base (144)..(144): c or u
  modified_base (151)..(151): c or u
  modified_base (154)..(154): c or u
  modified_base (160)..(160): c or u
  modified_base (171)..(171): c or u
  modified_base (174)..(174): c or u
  modified_base (177)..(177): c or u
  modified_base (183)..(183): c or u
  modified_base (186)..(186): c or u
  modified_base (188)..(188): c or u
  modified_base (201)..(201): c or u
  modified_base (211)..(211): c or u
  modified_base (222)..(222): c or u
  modified_base (226)..(226): c or u
  modified_base (229)..(229): c or u
  modified_base (232)..(232): c or u
  modified_base (235)..(235): c or u
  modified_base (241)..(241): c or u
  modified_base (243)..(243): c or u
  modified_base (248)..(248): c or u
  modified_base (258)..(258): c or u
  modified_base (274)..(274): c or u
  modified_base (277)..(277): c or u
  modified_base (282)..(282): c or u
  modified_base (285)..(285): c or u
  modified_base (291)..(291): c or u
guuutuutungtgutggguutgtuutauutuuagggnggaggngngggututgngtunggaggnguutngggngguagutunggtggggungngtutggtgngggguungggauuuaguaggguaguungggatggaguuaggngggagunganggagunguttauauuungungunggtgtngungnguttutuuttuunggggauuaungggtuuutggnggungungungungutgungngguungggaagutgngguutauaguagtggnggnggagnggngggtgnggguutggu

SEQ ID NO: 230 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (15)..(15): c or u
  modified_base (18)..(18): c or u
  modified_base (23)..(23): c or u
  modified_base (26)..(26): c or u
  modified_base (42)..(42): c or u
  modified_base (52)..(52): c or u
  modified_base (57)..(57): c or u
  modified_base (59)..(59): c or u
  modified_base (65)..(65): c or u
  modified_base (68)..(68): c or u
  modified_base (71)..(71): c or u
  modified_base (74)..(74): c or u
  modified_base (78)..(78): c or u
  modified_base (89)..(89): c or u
  modified_base (99)..(99): c or u
  modified_base (112)..(112): c or u
  modified_base (114)..(114): c or u
  modified_base (117)..(117): c or u
  modified_base (123)..(123): c or u
  modified_base (126)..(126): c or u
  modified_base (129)..(129): c or u
  modified_base (140)..(140): c or u
  modified_base (146)..(146): c or u
  modified_base (149)..(149): c or u
  modified_base (156)..(156): c or u
  modified_base (171)..(171): c or u
  modified_base (191)..(191): c or u
  modified_base (198)..(198): c or u
  modified_base (207)..(207): c or u
  modified_base (209)..(209): c or u
  modified_base (218)..(218): c or u
  modified_base (227)..(227): c or u
  modified_base (231)..(231): c or u
  modified_base (236)..(236): c or u
  modified_base (242)..(242): c or u
  modified_base (246)..(246): c or u
  modified_base (255)..(255): c or u
  modified_base (257)..(257): c or u
  modified_base (263)..(263): c or u
  modified_base (290)..(290): c or u
guuagguunguauungungutungunguuautgutgtaggunguaguttuungggungngguagnggnggnggnggunguuagggauunggtggtuuungggaaggagaagngnggngauaunggnggnggggtgtaagnggutungtnggutuunguutggutuuatuungggutguuutgutgggtuunggguuunguauuagangngguuuuaunggagutgunguungaggnguutungganguagaguungnguutunguuutggaggtaggauagguuuaguanggaggagggu

SEQ ID NO: 231 - DNA, 300 bp, Artificial Sequence
  Description of Artificial Sequence: Synthetic oligonucleotide
  Description of Combined DNA/RNA Molecule: Synthetic oligonucleotide
  modified_base (11)..(11): c or u
  modified_base (14)..(14): c or u
  modified_base (19)..(19): c or u
  modified_base (28)..(28): c or u
  modified_base (40)..(40): c or u
  modified_base (49)..(49): c or u
  modified_base (55)..(55): c or u
  modified_base (82)..(82): c or u
  modified_base (85)..(85): c or u
  modified_base (91)..(91): c or u
  modified_base (98)..(98): c or u
  modified_base (104)..(104): c or u
  modified_base (112)..(112): c or u
  modified_base (116)..(116): c or u
  modified_base (122)..(122): c or u
  modified_base (133)..(133): c or u
  modified_base (137)..(137): c or u
  modified_base (140)..(140): c or u
  modified_base (143)..(143): c or u
  modified_base (151)..(151): c or u
  modified_base (153)..(153): c or u
  modified_base (170)..(170): c or u
  modified_base (173)..(173): c or u
  modified_base (182)..(182): c or u
  modified_base (188)..(188): c or u
  modified_base (190)..(190): c or u
  modified_base (196)..(196): c or u
  modified_base (200)..(200): c or u
  modified_base (206)..(206): c or u
  modified_base (209)..(209): c or u
  modified_base (212)..(212): c or u
  modified_base (215)..(215): c or u
  modified_base (218)..(218): c or u
  modified_base (223)..(223): c or u
  modified_base (227)..(227): c or u
  modified_base (230)..(230): c or u
  modified_base (233)..(233): c or u
  modified_base (238)..(238): c or u
  modified_base (244)..(244): c or u
  modified_base (250)..(250): c or u
  modified_base (261)..(261): c or u
  modified_base (279)..(279): c or u
  modified_base (282)..(282): c or u
agaaaaguagngangtggngttuauuungutguagaautnggauuautngggutnggtguagggattggutuuagguttgungtnggggtngggagungaggangaggaggnggungggggnggutgutguungganggnggnggutgutngngutgutgutgutgutgngungggagtggnggutungngggutngggnggutunggnggngtngungguungggnggnggnggggngggutnggutgngutgtguutgnguutggguagggaguagnggngutautuautgtgggaut

SEQ ID NO: 232 - DNA, 300 bp, Artificial Sequence
  Description of Artificial Sequence: Synthetic oligonucleotide
  Description of Combined DNA/RNA Molecule: Synthetic oligonucleotide
  modified_base (18)..(18): c or u
  modified_base (21)..(21): c or u
  modified_base (39)..(39): c or u
  modified_base (50)..(50): c or u
  modified_base (56)..(56): c or u
  modified_base (62)..(62): c or u
  modified_base (67)..(67): c or u
  modified_base (70)..(70): c or u
  modified_base (73)..(73): c or u
  modified_base (77)..(77): c or u
  modified_base (82)..(82): c or u
  modified_base (85)..(85): c or u
  modified_base (88)..(88): c or u
  modified_base (91)..(91): c or u
  modified_base (94)..(94): c or u
  modified_base (100)..(100): c or u
  modified_base (104)..(104): c or u
  modified_base (110)..(110): c or u
  modified_base (112)..(112): c or u
  modified_base (118)..(118): c or u
  modified_base (127)..(127): c or u
  modified_base (130)..(130): c or u
  modified_base (147)..(147): c or u
  modified_base (149)..(149): c or u
  modified_base (157)..(157): c or u
  modified_base (160)..(160): c or u
  modified_base (163)..(163): c or u
  modified_base (167)..(167): c or u
  modified_base (178)..(178): c or u
  modified_base (184)..(184): c or u
  modified_base (188)..(188): c or u
  modified_base (196)..(196): c or u
  modified_base (202)..(202): c or u
  modified_base (209)..(209): c or u
  modified_base (215)..(215): c or u
  modified_base (218)..(218): c or u
  modified_base (245)..(245): c or u
  modified_base (251)..(251): c or u
  modified_base (260)..(260): c or u
  modified_base (272)..(272): c or u
  modified_base (281)..(281): c or u
  modified_base (286)..(286): c or u
  modified_base (289)..(289): c or u
agtuuuauagtgagtagngungutgutuuutguuuaggnguagguauagnguagungaguunguuungungunguungggunggngangungunggagunguungaguungnggagunguuautuunggnguaguaguaguaguagngngaguagungungungtunggguaguagunguuuunggunguutuutngtuutnggutuungauuungangguaaguutggaguuaatuuutguaungaguungagtggtungagttutguagnggggtgaanguuangtngutguttttut

SEQ ID NO: 233 - DNA, 300 bp, Artificial Sequence
  Description of Artificial Sequence: Synthetic oligonucleotide
  Description of Combined DNA/RNA Molecule: Synthetic oligonucleotide
  modified_base (64)..(64): c or u
  modified_base (121)..(121): c or u
  modified_base (123)..(123): c or u
  modified_base (131)..(131): c or u
  modified_base (134)..(134): c or u
  modified_base (143)..(143): c or u
  modified_base (151)..(151): c or u
  modified_base (153)..(153): c or u
  modified_base (160)..(160): c or u
  modified_base (162)..(162): c or u
  modified_base (166)..(166): c or u
  modified_base (177)..(177): c or u
  modified_base (182)..(182): c or u
  modified_base (187)..(187): c or u
  modified_base (197)..(197): c or u
  modified_base (199)..(199): c or u
  modified_base (203)..(203): c or u
  modified_base (217)..(217): c or u
  modified_base (223)..(223): c or u
  modified_base (232)..(232): c or u
  modified_base (234)..(234): c or u
  modified_base (238)..(238): c or u
  modified_base (242)..(242): c or u
  modified_base (247)..(247): c or u
  modified_base (249)..(249): c or u
  modified_base (252)..(252): c or u
  modified_base (255)..(255): c or u
  modified_base (288)..(288): c or u
gtgtgtgtgtgtgtgtgtgtgtgtgtgtgtgtgtgtgtgtgtgtgtgtaatguatttagaggangggagutguututagggagaaaggggaggggggaggggagaagaaaaaggaaagagngngtttuutngunggggttaunggggtggngnggguttngnggungaggggutgungguungguunguagutuutngnggunggutgggaagtggngggtunggutagtungngggngggnggagngngungtngutguuagtgtuuuuutttaauattuuttuuungaguutttuuut

SEQ ID NO: 234 - DNA, 300 bp, Artificial Sequence
  Description of Artificial Sequence: Synthetic oligonucleotide
  Description of Combined DNA/RNA Molecule: Synthetic oligonucleotide
  modified_base (12)..(12): c or u
  modified_base (45)..(45): c or u
  modified_base (48)..(48): c or u
  modified_base (51)..(51): c or u
  modified_base (53)..(53): c or u
  modified_base (58)..(58): c or u
  modified_base (62)..(62): c or u
  modified_base (66)..(66): c or u
  modified_base (68)..(68): c or u
  modified_base (77)..(77): c or u
  modified_base (83)..(83): c or u
  modified_base (97)..(97): c or u
  modified_base (101)..(101): c or u
  modified_base (103)..(103): c or u
  modified_base (113)..(113): c or u
  modified_base (118)..(118): c or u
  modified_base (123)..(123): c or u
  modified_base (134)..(134): c or u
  modified_base (138)..(138): c or u
  modified_base (140)..(140): c or u
  modified_base (147)..(147): c or u
  modified_base (149)..(149): c or u
  modified_base (157)..(157): c or u
  modified_base (166)..(166): c or u
  modified_base (169)..(169): c or u
  modified_base (177)..(177): c or u
  modified_base (179)..(179): c or u
  modified_base (236)..(236): c or u
agggaaaggutnggggaaggaatgttaaagggggauautgguagnganggngngutunguunguungnggautagunggauunguuauttuuuagunggungngaggagutgngggungggungguaguuuutnggungngaaguungnguuauuunggtaauuunggngaggaaangngututttuutttttuttutuuuutuuuuuutuuuutttutuuutagagguagutuungtuututaaatguattauauauauauauauauauauauauauauauauauauauauauauauau

SEQ ID NO: 235 - DNA, 300 bp, Artificial Sequence
  Description of Artificial Sequence: Synthetic oligonucleotide
  Description of Combined DNA/RNA Molecule: Synthetic oligonucleotide
  modified_base (9)..(9): c or u
  modified_base (21)..(21): c or u
  modified_base (57)..(57): c or u
  modified_base (67)..(67): c or u
  modified_base (82)..(82): c or u
  modified_base (88)..(88): c or u
  modified_base (95)..(95): c or u
  modified_base (97)..(97): c or u
  modified_base (99)..(99): c or u
  modified_base (103)..(103): c or u
  modified_base (123)..(123): c or u
  modified_base (140)..(140): c or u
  modified_base (150)..(150): c or u
  modified_base (171)..(171): c or u
  modified_base (181)..(181): c or u
  modified_base (183)..(183): c or u
  modified_base (212)..(212): c or u
  modified_base (214)..(214): c or u
  modified_base (235)..(235): c or u
  modified_base (238)..(238): c or u
  modified_base (248)..(248): c or u
  modified_base (250)..(250): c or u
  modified_base (279)..(279): c or u
  modified_base (299)..(299): c or u
utuutgggngauutaaauttngataautgutggaaaggtuuaguaggagaggagggngaggaggggnggaguuaggagguungguuunguuuaungngnguunguututututguagauuaunggutagaguaggaguangagututtungutgtttuuaggatuuutgunggutggguangnguuaaaaguaguuutggguuutgggtatngnguttggggggagggtauuuungunggutggguangnguuaagaguaguuutggguuutgggtatngtguttagggggagggtatng

SEQ ID NO: 236 - DNA, 300 bp, Artificial Sequence
  Description of Artificial Sequence: Synthetic oligonucleotide
  Description of Combined DNA/RNA Molecule: Synthetic oligonucleotide
  modified_base (1)..(1): c or u
  modified_base (21)..(21): c or u
  modified_base (50)..(50): c or u
  modified_base (52)..(52): c or u
  modified_base (62)..(62): c or u
  modified_base (65)..(65): c or u
  modified_base (86)..(86): c or u
  modified_base (88)..(88): c or u
  modified_base (117)..(117): c or u
  modified_base (119)..(119): c or u
  modified_base (129)..(129): c or u
  modified_base (150)..(150): c or u
  modified_base (160)..(160): c or u
  modified_base (177)..(177): c or u
  modified_base (197)..(197): c or u
  modified_base (201)..(201): c or u
  modified_base (203)..(203): c or u
  modified_base (205)..(205): c or u
  modified_base (212)..(212): c or u
  modified_base (218)..(218): c or u
  modified_base (233)..(233): c or u
  modified_base (243)..(243): c or u
  modified_base (279)..(279): c or u
  modified_base (291)..(291): c or u
ngatauuutuuuuutaaguangatauuuaggguuuagggutgututtggngngtguuuagunggngggggtauuutuuuuuuaagngngatauuuaggguuuagggutguttttggngngtguuuagungguagggatuutggaaauagnggaagagutngtgutuutgututagunggtggtutguagagagaggngggngngnggtgggnggggunggguutuutggutunguuuutuutnguuutuututuutgutggauutttuuaguagttatngaagtttaggtnguuuaggag

SEQ ID NO: 237 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (6)..(6): c or u
  modified_base (10)..(10): c or u
  modified_base (30)..(30): c or u
  modified_base (32)..(32): c or u
  modified_base (37)..(37): c or u
  modified_base (39)..(39): c or u
  modified_base (45)..(45): c or u
  modified_base (58)..(58): c or u
  modified_base (63)..(63): c or u
  modified_base (69)..(69): c or u
  modified_base (74)..(74): c or u
  modified_base (85)..(85): c or u
  modified_base (95)..(95): c or u
  modified_base (101)..(101): c or u
  modified_base (108)..(108): c or u
  modified_base (116)..(116): c or u
  modified_base (135)..(135): c or u
  modified_base (151)..(151): c or u
  modified_base (164)..(164): c or u
  modified_base (170)..(170): c or u
  modified_base (173)..(173): c or u
  modified_base (182)..(182): c or u
  modified_base (186)..(186): c or u
  modified_base (195)..(195): c or u
  modified_base (200)..(200): c or u
  modified_base (202)..(202): c or u
  modified_base (211)..(211): c or u
  modified_base (223)..(223): c or u
  modified_base (225)..(225): c or u
  modified_base (228)..(228): c or u
  modified_base (230)..(230): c or u
  modified_base (234)..(234): c or u
  modified_base (236)..(236): c or u
  modified_base (245)..(245): c or u
  modified_base (247)..(247): c or u
  modified_base (249)..(249): c or u
  modified_base (254)..(254): c or u
  modified_base (258)..(258): c or u
  modified_base (262)..(262): c or u
  modified_base (266)..(266): c or u
ggngungggngutggguttauaguagagungngggungnggggtnggaaagtuuttunggggnggggunguagngguututtuunguaguuuutnggguunggguuunggtggaanggaaauutuuuuutauuungggaggggutguuagngggutgggggtgngaaaanggngguaggagngggngagggguungggungnguautttgnguutgggtttgngngungnggungngggagtuungngnggaunggungganguungguutuuuuuaguuuuagutttttgtgtgtgtgt

SEQ ID NO: 238 - DNA, 300 bp, Artificial Sequence
  Description of Artificial Sequence: Synthetic oligonucleotide
  Description of Combined DNA/RNA Molecule: Synthetic oligonucleotide
  modified_base (34)..(34): c or u
  modified_base (38)..(38): c or u
  modified_base (42)..(42): c or u
  modified_base (46)..(46): c or u
  modified_base (51)..(51): c or u
  modified_base (53)..(53): c or u
  modified_base (55)..(55): c or u
  modified_base (64)..(64): c or u
  modified_base (66)..(66): c or u
  modified_base (70)..(70): c or u
  modified_base (72)..(72): c or u
  modified_base (75)..(75): c or u
  modified_base (77)..(77): c or u
  modified_base (89)..(89): c or u
  modified_base (98)..(98): c or u
  modified_base (100)..(100): c or u
  modified_base (105)..(105): c or u
  modified_base (114)..(114): c or u
  modified_base (118)..(118): c or u
  modified_base (127)..(127): c or u
  modified_base (130)..(130): c or u
  modified_base (136)..(136): c or u
  modified_base (149)..(149): c or u
  modified_base (165)..(165): c or u
  modified_base (184)..(184): c or u
  modified_base (192)..(192): c or u
  modified_base (199)..(199): c or u
  modified_base (205)..(205): c or u
  modified_base (215)..(215): c or u
  modified_base (226)..(226): c or u
  modified_base (231)..(231): c or u
  modified_base (237)..(237): c or u
  modified_base (242)..(242): c or u
  modified_base (255)..(255): c or u
  modified_base (261)..(261): c or u
  modified_base (263)..(263): c or u
  modified_base (268)..(268): c or u
  modified_base (270)..(270): c or u
  modified_base (290)..(290): c or u
  modified_base (294)..(294): c or u
  modified_base (297)..(297): c or u
auauauauauaaaaagutggggutgggggaggungggngtunggunggtungngngggautuungnggungnggngnguaaauuuaggnguaaagtgngngguunggguuuutnguungutuutgungungttttnguauuuuuaguungutgguaguuuutuunggggtagggggaggtttungttuuaungggguunggguungaggggutgngggaagaggungutgngguuunguuunggaaggautttungauuungngguungnggututgutgtaaguuuagnguunggnguu

SEQ ID NO: 239 - DNA, 300 bp, Artificial Sequence
  Description of Artificial Sequence: Synthetic oligonucleotide
  Description of Combined DNA/RNA Molecule: Synthetic oligonucleotide
  modified_base (14)..(14): c or u
  modified_base (20)..(20): c or u
  modified_base (34)..(34): c or u
  modified_base (64)..(64): c or u
  modified_base (98)..(98): c or u
  modified_base (100)..(100): c or u
  modified_base (110)..(110): c or u
  modified_base (118)..(118): c or u
  modified_base (120)..(120): c or u
  modified_base (128)..(128): c or u
  modified_base (150)..(150): c or u
  modified_base (167)..(167): c or u
  modified_base (179)..(179): c or u
  modified_base (185)..(185): c or u
  modified_base (226)..(226): c or u
  modified_base (241)..(241): c or u
  modified_base (249)..(249): c or u
  modified_base (256)..(256): c or u
  modified_base (265)..(265): c or u
  modified_base (285)..(285): c or u
  modified_base (295)..(295): c or u
  modified_base (297)..(297): c or u
agguauagaaaggnguagungutaguuagaguunguauagaguuagaguuaggtuuuuautggnguagatgggggautguagguauaguagtaguuangngggtgtaaangtagagungngtgaauungggttgtgggatuuuagguuungauuaguuuuuatuuunggutgguatutnggtuunggggagtutuaguttuuutttutguagaatgggutggaggnguuuuuuauagguunguuuaggnguuuuungggguuagnguuuutuuuuuauutguuunguuuuuauungnggg

SEQ ID NO: 240 - DNA, 300 bp, Artificial Sequence
  Description of Artificial Sequence: Synthetic oligonucleotide
  Description of Combined DNA/RNA Molecule: Synthetic oligonucleotide
  modified_base (3)..(3): c or u
  modified_base (5)..(5): c or u
  modified_base (15)..(15): c or u
  modified_base (35)..(35): c or u
  modified_base (44)..(44): c or u
  modified_base (51)..(51): c or u
  modified_base (59)..(59): c or u
  modified_base (74)..(74): c or u
  modified_base (115)..(115): c or u
  modified_base (121)..(121): c or u
  modified_base (133)..(133): c or u
  modified_base (150)..(150): c or u
  modified_base (172)..(172): c or u
  modified_base (180)..(180): c or u
  modified_base (182)..(182): c or u
  modified_base (190)..(190): c or u
  modified_base (200)..(200): c or u
  modified_base (202)..(202): c or u
  modified_base (236)..(236): c or u
  modified_base (266)..(266): c or u
  modified_base (280)..(280): c or u
  modified_base (286)..(286): c or u
uungngggtgggggngggguaggtgggggaggggngutgguuunggggggnguutgggnggguutgtggggggnguutuuaguuuattutguagaaagggaagutgagautuuungggaungagatguuagunggggatgggggutggtngggguutgggatuuuauaauungggttuangnggututangtttauauungngtggutautgutgtguutguagtuuuuuatutgnguuagtggggauutggututggututgtgngggututggutagnggutgnguutttutgtguut

SEQ ID NO: 241 - DNA, 300 bp, Artificial Sequence
  Description of Artificial Sequence: Synthetic oligonucleotide
  Description of Combined DNA/RNA Molecule: Synthetic oligonucleotide
  modified_base (6)..(6): c or u
  modified_base (8)..(8): c or u
  modified_base (14)..(14): c or u
  modified_base (23)..(23): c or u
  modified_base (26)..(26): c or u
  modified_base (29)..(29): c or u
  modified_base (35)..(35): c or u
  modified_base (38)..(38): c or u
  modified_base (47)..(47): c or u
  modified_base (51)..(51): c or u
  modified_base (58)..(58): c or u
  modified_base (63)..(63): c or u
  modified_base (69)..(69): c or u
  modified_base (72)..(72): c or u
  modified_base (78)..(78): c or u
  modified_base (89)..(89): c or u
  modified_base (98)..(98): c or u
  modified_base (105)..(105): c or u
  modified_base (107)..(107): c or u
  modified_base (112)..(112): c or u
  modified_base (114)..(114): c or u
  modified_base (126)..(126): c or u
  modified_base (132)..(132): c or u
  modified_base (140)..(140): c or u
  modified_base (150)..(150): c or u
  modified_base (152)..(152): c or u
  modified_base (159)..(159): c or u
  modified_base (173)..(173): c or u
  modified_base (178)..(178): c or u
  modified_base (184)..(184): c or u
  modified_base (193)..(193): c or u
  modified_base (197)..(197): c or u
  modified_base (211)..(211): c or u
  modified_base (214)..(214): c or u
  modified_base (217)..(217): c or u
  modified_base (224)..(224): c or u
  modified_base (230)..(230): c or u
  modified_base (235)..(235): c or u
  modified_base (238)..(238): c or u
  modified_base (244)..(244): c or u
  modified_base (247)..(247): c or u
  modified_base (252)..(252): c or u
  modified_base (261)..(261): c or u
  modified_base (268)..(268): c or u
  modified_base (283)..(283): c or u
  modified_base (290)..(290): c or u
ggggungnggagtngggtgaggnggnggnggutgnggnggtggggungggngaggtungutgnggtuunggnggutungtggutgutungututgagnguutggngnguuungnguuutuuutgunggggungutgggunggggatguangngggguungggaguuatggtunguttnggggangagutgggnggungutatggggguuunggnggnggagagnggguunggggnggnggggunggnggggngggggguungggtuunggggggutguaguungguuagngggtuututa

SEQ ID NO: 242 - DNA, 300 bp, Artificial Sequence
  Description of Artificial Sequence: Synthetic oligonucleotide
  Description of Combined DNA/RNA Molecule: Synthetic oligonucleotide
  modified_base (10)..(10): c or u
  modified_base (17)..(17): c or u
  modified_base (32)..(32): c or u
  modified_base (39)..(39): c or u
  modified_base (48)..(48): c or u
  modified_base (53)..(53): c or u
  modified_base (56)..(56): c or u
  modified_base (62)..(62): c or u
  modified_base (65)..(65): c or u
  modified_base (70)..(70): c or u
  modified_base (76)..(76): c or u
  modified_base (83)..(83): c or u
  modified_base (86)..(86): c or u
  modified_base (89)..(89): c or u
  modified_base (103)..(103): c or u
  modified_base (107)..(107): c or u
  modified_base (116)..(116): c or u
  modified_base (122)..(122): c or u
  modified_base (127)..(127): c or u
  modified_base (141)..(141): c or u
  modified_base (148)..(148): c or u
  modified_base (150)..(150): c or u
  modified_base (160)..(160): c or u
  modified_base (168)..(168): c or u
  modified_base (174)..(174): c or u
  modified_base (186)..(186): c or u
  modified_base (188)..(188): c or u
  modified_base (193)..(193): c or u
  modified_base (195)..(195): c or u
  modified_base (202)..(202): c or u
  modified_base (211)..(211): c or u
  modified_base (222)..(222): c or u
  modified_base (228)..(228): c or u
  modified_base (231)..(231): c or u
  modified_base (237)..(237): c or u
  modified_base (242)..(242): c or u
  modified_base (249)..(249): c or u
  modified_base (253)..(253): c or u
  modified_base (262)..(262): c or u
  modified_base (265)..(265): c or u
  modified_base (271)..(271): c or u
  modified_base (274)..(274): c or u
  modified_base (277)..(277): c or u
  modified_base (286)..(286): c or u
  modified_base (292)..(292): c or u
  modified_base (294)..(294): c or u
tagaggauungutggungggutguaguuuuungggauunggguuuuunguuungungguuungunguuunggguungututungungungggguuuuuatagnggunguuuagutngtuuungaagnggauuatggutuunggguuungngtguatuuungguuuagngguuungguagggagggngnggggngnguuaggngutuagagnggaguaguuanggagungungggaunguagnggauutnguungguuuuaungunguagungungunguutuauungautungngguuuu

SEQ ID NO: 243 - DNA, 23 bp, Artificial Sequence
  Description of Artificial Sequence: Synthetic oligonucleotide
gttttttttttaaagtagttttt

SEQ ID NO: 244 - DNA, 18 bp, Artificial Sequence
  Description of Artificial Sequence: Synthetic oligonucleotide
ctcctacaacccccttcc

SEQ ID NO: 245 - DNA, 22 bp, Artificial Sequence
  Description of Artificial Sequence: Synthetic oligonucleotide
ttttgagtagttggagttatag

SEQ ID NO: 246 - DNA, 22 bp, Artificial Sequence
  Description of Artificial Sequence: Synthetic oligonucleotide
taaattcatcctctacctatta

SEQ ID NO: 247 - DNA, 23 bp, Artificial Sequence
  Description of Artificial Sequence: Synthetic oligonucleotide
atggtatgaattaattaatttga

SEQ ID NO: 248 - DNA, 21 bp, Artificial Sequence
  Description of Artificial Sequence: Synthetic oligonucleotide
ctccctaaaaaaaaaaataaa

SEQ ID NO: 249 - DNA, 25 bp, Artificial Sequence
  Description of Artificial Sequence: Synthetic oligonucleotide
tatttgtttgattttaattatattt

SEQ ID NO: 250 - DNA, 23 bp, Artificial Sequence
  Description of Artificial Sequence: Synthetic oligonucleotide
aaactctactctctaaacctttc

SEQ ID NO: 251 - DNA, 27 bp, Artificial Sequence
  Description of Artificial Sequence: Synthetic oligonucleotide
attttattgattatgtttagttgatta

SEQ ID NO: 252 - DNA, 19 bp, Artificial Sequence
  Description of Artificial Sequence: Synthetic oligonucleotide
aaaaataccccaaaaacaa

SEQ ID NO: 253 - DNA, 21 bp, Artificial Sequence
  Description of Artificial Sequence: Synthetic oligonucleotide
gtggaagggaaaaaaaaagag

SEQ ID NO: 254 - DNA, 24 bp, Artificial Sequence
  Description of Artificial Sequence: Synthetic oligonucleotide
acaaactcccctatacctcaaata

SEQ ID NO: 255 - DNA, 20 bp, Artificial Sequence
  Description of Artificial Sequence: Synthetic oligonucleotide
ttttttaaatggtgaaatat

SEQ ID NO: 256 - DNA, 22 bp, Artificial Sequence
  Description of Artificial Sequence: Synthetic oligonucleotide
aattttacttcttcttcttatc

SEQ ID NO: 257 - DNA, 21 bp, Artificial Sequence
  Description of Artificial Sequence: Synthetic oligonucleotide
tggtaataattggaggaattg

SEQ ID NO: 258 - DNA, 28 bp, Artificial Sequence
  Description of Artificial Sequence: Synthetic oligonucleotide
acaaataaaatcataaaaaataacaaac

SEQ ID NO: 259 - DNA, 23 bp, Artificial Sequence
  Description of Artificial Sequence: Synthetic oligonucleotide
gattttttgatttgaaaatagtt

SEQ ID NO: 260 - DNA, 18 bp, Artificial Sequence
  Description of Artificial Sequence: Synthetic oligonucleotide
aatctcaaccccaaactc

SEQ ID NO: 261 - DNA, 24 bp, Artificial Sequence
  Description of Artificial Sequence: Synthetic oligonucleotide
ttaggtaaagatttggttttagaa

SEQ ID NO: 262 - DNA, 30 bp, Artificial Sequence
  Description of Artificial Sequence: Synthetic oligonucleotide
aacttattatataaattataaaaaaataaa

SEQ ID NO: 263 - DNA, 23 bp, Artificial Sequence
  Description of Artificial Sequence: Synthetic oligonucleotide
ggaggtgttttttagtaagtttg

SEQ ID NO: 264 - DNA, 24 bp, Artificial Sequence
  Description of Artificial Sequence: Synthetic oligonucleotide
cctcatacctataacctacactca

SEQ ID NO: 265 - DNA, 23 bp, Artificial Sequence
  Description of Artificial Sequence: Synthetic oligonucleotide
aagggttgttatgttagtgtagt

SEQ ID NO: 266 - DNA, 23 bp, Artificial Sequence
  Description of Artificial Sequence: Synthetic oligonucleotide
cccaaaaataaataatttaacta

SEQ ID NO: 267 - DNA, 23 bp, Artificial Sequence
  Description of Artificial Sequence: Synthetic oligonucleotide
atttttgttttaatatggagttg

SEQ ID NO: 268 - DNA, 25 bp, Artificial Sequence
  Description of Artificial Sequence: Synthetic oligonucleotide
aaacctaaatctacacttaaacatc

SEQ ID NO: 269 - DNA, 18 bp, Artificial Sequence
  Description of Artificial Sequence: Synthetic oligonucleotide
agggttagggtttttttg

SEQ ID NO: 270 - DNA, 27 bp, Artificial Sequence
  Description of Artificial Sequence: Synthetic oligonucleotide
aaatctctttattactcattttctata

SEQ ID NO: 271 - DNA, 29 bp, Artificial Sequence
  Description of Artificial Sequence: Synthetic oligonucleotide
gttatttatatttttgagtattaagagtt

SEQ ID NO: 272 - DNA, 22 bp, Artificial Sequence
  Description of Artificial Sequence: Synthetic oligonucleotide
accaacaaatacaacaccttct

SEQ ID NO: 273 - DNA, 26 bp, Artificial Sequence
  Description of Artificial Sequence: Synthetic oligonucleotide
ggttttttagttttatgaattattta

SEQ ID NO: 274 - DNA, 21 bp, Artificial Sequence
  Description of Artificial Sequence: Synthetic oligonucleotide
aacccctctacaacctactac

SEQ ID NO: 275 - DNA, 21 bp, Artificial Sequence
  Description of Artificial Sequence: Synthetic oligonucleotide
gatgaggaagttgaggtatag

SEQ ID NO: 276 - DNA, 18 bp, Artificial Sequence
  Description of Artificial Sequence: Synthetic oligonucleotide
ctccaacccattctacaa

SEQ ID NO: 277 - DNA, 23 bp, Artificial Sequence
  Description of Artificial Sequence: Synthetic oligonucleotide
gaggggattgagtaggtgaatag

SEQ ID NO: 278 - DNA, 29 bp, Artificial Sequence
  Description of Artificial Sequence: Synthetic oligonucleotide
caaaacaaaaaaaaaataaaaaaaaaact

SEQ ID NO: 279 - DNA, 22 bp, Artificial Sequence
  Description of Artificial Sequence: Synthetic oligonucleotide
aaggagaggagaagaggtatag

SEQ ID NO: 280 - DNA, 27 bp, Artificial Sequence
  Description of Artificial Sequence: Synthetic oligonucleotide
aataataaaaaaaaactaaattcaaac

SEQ ID NO: 281 - DNA, 19 bp, Artificial Sequence
  Description of Artificial Sequence: Synthetic oligonucleotide
ttggggtttagggatttag

SEQ ID NO: 282 - DNA, 27 bp, Artificial Sequence
  Description of Artificial Sequence: Synthetic oligonucleotide
aataaaatatacctcctttcaaactaa

SEQ ID NO: 283 - DNA, 26 bp, Artificial Sequence
  Description of Artificial Sequence: Synthetic oligonucleotide
aaaggttaaattaaaaatttttttat

SEQ ID NO: 284 - DNA, 24 bp, Artificial Sequence
  Description of Artificial Sequence: Synthetic oligonucleotide
ctcccaactatacttcttaatctc

SEQ ID NO: 285 - DNA, 28 bp, Artificial Sequence
  Description of Artificial Sequence: Synthetic oligonucleotide
ggtttagagttattgaataaatgaagtg

SEQ ID NO: 286 - DNA, 22 bp, Artificial Sequence
  Description of Artificial Sequence: Synthetic oligonucleotide
caaaatcaaattctccaacaaa

SEQ ID NO: 287 - DNA, 18 bp, Artificial Sequence
  Description of Artificial Sequence: Synthetic oligonucleotide
tgatggaggaagtttttg

SEQ ID NO: 288 - DNA, 20 bp, Artificial Sequence
  Description of Artificial Sequence: Synthetic oligonucleotide
aaccctaaactaaacaaccc

SEQ ID NO: 289 - DNA, 24 bp, Artificial Sequence
  Description of Artificial Sequence: Synthetic oligonucleotide
ttaaggatttagatattttgtaat

SEQ ID NO: 290 - DNA, 27 bp, Artificial Sequence
  Description of Artificial Sequence: Synthetic oligonucleotide
aataaatttataaatttactctcttac

SEQ ID NO: 291 - DNA, 23 bp, Artificial Sequence
  Description of Artificial Sequence: Synthetic oligonucleotide
aatgttttggagattagtaatat

SEQ ID NO: 292 - DNA, 21 bp, Artificial Sequence
  Description of Artificial Sequence: Synthetic oligonucleotide
tcttcctaaaaaaaaaataaa

SEQ ID NO: 293 - DNA, 19 bp, Artificial Sequence
  Description of Artificial Sequence: Synthetic oligonucleotide
gggaataatgaggaggaga

SEQ ID NO: 294 - DNA, 29 bp, Artificial Sequence
  Description of Artificial Sequence: Synthetic oligonucleotide
aaaaatacaataaaaaatcttaaaataaa

SEQ ID NO: 295 - DNA, 18 bp, Artificial Sequence
  Description of Artificial Sequence: Synthetic oligonucleotide
ggtaggggattgggatag

SEQ ID NO: 296 - DNA, 29 bp, Artificial Sequence
  Description of Artificial Sequence: Synthetic oligonucleotide
aacaaaacaaaactataaaattaaactaa

SEQ ID NO: 297 - DNA, 20 bp, Artificial Sequence
  Description of Artificial Sequence: Synthetic oligonucleotide
ggttaggagattagggattg

SEQ ID NO: 298 - DNA, 24 bp, Artificial Sequence
  Description of Artificial Sequence: Synthetic oligonucleotide
aaaaaaaaaaacaacttaaaaaac

SEQ ID NO: 299 - DNA, 24 bp, Artificial Sequence
  Description of Artificial Sequence: Synthetic oligonucleotide
tgtttattttagaggtgtttattt

SEQ ID NO: 300 - DNA, 18 bp, Artificial Sequence
  Description of Artificial Sequence: Synthetic oligonucleotide
accctaatccaatatccc

SEQ ID NO: 301 - DNA, 20 bp, Artificial Sequence
  Description of Artificial Sequence: Synthetic oligonucleotide
ggttggttaggttgttattt

SEQ ID NO: 302 - DNA, 20 bp, Artificial Sequence
  Description of Artificial Sequence: Synthetic oligonucleotide
caaacaccacatacttattc

SEQ ID NO: 303 - DNA, 18 bp, Artificial Sequence
  Description of Artificial Sequence: Synthetic oligonucleotide
tttgggtttagaaagttg

SEQ ID NO: 304 - DNA, 22 bp, Artificial Sequence
  Description of Artificial Sequence: Synthetic oligonucleotide
caaaaactaaaaaaaaaataac

SEQ ID NO: 305 - DNA, 19 bp, Artificial Sequence
  Description of Artificial Sequence: Synthetic oligonucleotide
ttttgagtttggtttagtt

SEQ ID NO: 306 - DNA, 20 bp, Artificial Sequence
  Description of Artificial Sequence: Synthetic oligonucleotide
cctaaaaaaaataaaaatcc

SEQ ID NO: 307 - DNA, 18 bp, Artificial Sequence
  Description of Artificial Sequence: Synthetic oligonucleotide
ggaatttggagggtaaaa

SEQ ID NO: 308 - DNA, 31 bp, Artificial Sequence
  Description of Artificial Sequence: Synthetic oligonucleotide
ctaatctctatcctatatatttctttatatt

SEQ ID NO: 309 - DNA, 21 bp, Artificial Sequence
  Description of Artificial Sequence: Synthetic oligonucleotide
tattatattgttatgttgatt

SEQ ID NO: 310 - DNA, 21 bp, Artificial Sequence
  Description of Artificial Sequence: Synthetic oligonucleotide
atattaatttcttccaactaa

SEQ ID NO: 311 - DNA, 21 bp, Artificial Sequence
  Description of Artificial Sequence: Synthetic oligonucleotide
tgggattggtaagtaggtatt

SEQ ID NO: 312 - DNA, 26 bp, Artificial Sequence
  Description of Artificial Sequence: Synthetic oligonucleotide
aaaaaaaaaaacctataacctataaa

SEQ ID NO: 313 - DNA, 19 bp, Artificial Sequence
  Description of Artificial Sequence: Synthetic oligonucleotide
atggtttttgtttgtagac

SEQ ID NO: 314 - DNA, 28 bp, Artificial Sequence
  Description of Artificial Sequence: Synthetic oligonucleotide
attattattatttatttatttattatca

SEQ ID NO: 315 - DNA, 30 bp, Artificial Sequence
  Description of Artificial Sequence: Synthetic oligonucleotide
tttttttgaaagttagtgaatttatttatt

SEQ ID NO: 316 - DNA, 18 bp, Artificial Sequence
  Description of Artificial Sequence: Synthetic oligonucleotide
acccatctccccacacac

SEQ ID NO: 317 - DNA, 20 bp, Artificial Sequence
  Description of Artificial Sequence: Synthetic oligonucleotide
ttggggtttaaaggtattag

SEQ ID NO: 318 - DNA, 25 bp, Artificial Sequence
  Description of Artificial Sequence: Synthetic oligonucleotide
aaaacaaaaactactaaaaaaaaat

SEQ ID NO: 319 - DNA, 23 bp, Artificial Sequence
  Description of Artificial Sequence: Synthetic oligonucleotide
ttggttaaggaagaaaggagtag

SEQ ID NO: 320 - DNA, 18 bp, Artificial Sequence
  Description of Artificial Sequence: Synthetic oligonucleotide
cacccccttcaaaaaaaa

SEQ ID NO: 321 - DNA, 19 bp, Artificial Sequence
  Description of Artificial Sequence: Synthetic oligonucleotide
tggggttttttggtttttt

SEQ ID NO: 322 - DNA, 19 bp, Artificial Sequence
  Description of Artificial Sequence: Synthetic oligonucleotide
ccacctcacaaacacacac

SEQ ID NO: 323 - DNA, 24 bp, Artificial Sequence
  Description of Artificial Sequence: Synthetic oligonucleotide
agaaaggtatttgtttttagtaaa

SEQ ID NO: 324 - DNA, 22 bp, Artificial Sequence
  Description of Artificial Sequence: Synthetic oligonucleotide
ttacaaaataaaaccaacctat

SEQ ID NO: 325 - DNA, 24 bp, Artificial Sequence
  Description of Artificial Sequence: Synthetic oligonucleotide
gagtttttttttttatttagtttt

SEQ ID NO: 326 - DNA, 20 bp, Artificial Sequence
  Description of Artificial Sequence: Synthetic oligonucleotide
cctaccccctaatatctaca

SEQ ID NO: 327 - DNA, 23 bp, Artificial Sequence
  Description of Artificial Sequence: Synthetic oligonucleotide
tttttttaatatttgtgaattat

SEQ ID NO: 328 - DNA, 20 bp, Artificial Sequence
  Description of Artificial Sequence: Synthetic oligonucleotide
aaacaacaaccctaactatc

SEQ ID NO: 329 - DNA, 21 bp, Artificial Sequence
  Description of Artificial Sequence: Synthetic oligonucleotide
atggaagttggagttgagaag

SEQ ID NO: 330 - DNA, 26 bp, Artificial Sequence
  Description of Artificial Sequence: Synthetic oligonucleotide
acacctaaaacaaaaataaaaaaatc

SEQ ID NO: 331 - DNA, 24 bp, Artificial Sequence
  Description of Artificial Sequence: Synthetic oligonucleotide
attagtttttagttttttagtatt

SEQ ID NO: 332 - DNA, 18 bp, Artificial Sequence
  Description of Artificial Sequence: Synthetic oligonucleotide
tccccttaacattaaatc

SEQ ID NO: 333 - DNA, 24 bp, Artificial Sequence
  Description of Artificial Sequence: Synthetic oligonucleotide
ttgagattagattagagtttattt

SEQ ID NO: 334 - DNA, 22 bp, Artificial Sequence
  Description of Artificial Sequence: Synthetic oligonucleotide
aaaaaaaccttaatcctataat

SEQ ID NO: 335 - DNA, 24 bp, Artificial Sequence
  Description of Artificial Sequence: Synthetic oligonucleotide
tttttagtagggttaagaggattt

SEQ ID NO: 336 - DNA, 18 bp, Artificial Sequence
  Description of Artificial Sequence: Synthetic oligonucleotide
tccaatacacaccaccaa

SEQ ID NO: 337 - DNA, 23 bp, Artificial Sequence
  Description of Artificial Sequence: Synthetic oligonucleotide
tttgaatggtagaggaaatagtt

SEQ ID NO: 338 - DNA, 22 bp, Artificial Sequence
  Description of Artificial Sequence: Synthetic oligonucleotide
acccaaaaattctatctttcac

SEQ ID NO: 339 - DNA, 22 bp, Artificial Sequence
  Description of Artificial Sequence: Synthetic oligonucleotide
tttatgggtttttattttagta

SEQ ID NO: 340 - DNA, 23 bp, Artificial Sequence
  Description of Artificial Sequence: Synthetic oligonucleotide
aaaaatattccaatataaacaaa

SEQ ID NO: 341 - DNA, 23 bp, Artificial Sequence
  Description of Artificial Sequence: Synthetic oligonucleotide
agagttgttgttgttttttatgt

SEQ ID NO: 342 - DNA, 22 bp, Artificial Sequence
  Description of Artificial Sequence: Synthetic oligonucleotide
caacccaaaatccttaactata

SEQ ID NO: 343 - DNA, 23 bp, Artificial Sequence
  Description of Artificial Sequence: Synthetic oligonucleotide
aaaagaattagggtaggtatagt

SEQ ID NO: 344 - DNA, 23 bp, Artificial Sequence
  Description of Artificial Sequence: Synthetic oligonucleotide
cttaatcaataatctccaaatat

SEQ ID NO: 345 - DNA, 20 bp, Artificial Sequence
  Description of Artificial Sequence: Synthetic oligonucleotide
tttggttatggaggtatagt

SEQ ID NO: 346 - DNA, 20 bp, Artificial Sequence
  Description of Artificial Sequence: Synthetic oligonucleotide
aaaaaaaaaataaataatac

SEQ ID NO: 347 - DNA, 23 bp, Artificial Sequence
  Description of Artificial Sequence: Synthetic oligonucleotide
attttatttggggatttttaata

SEQ ID NO: 348 - DNA, 25 bp, Artificial Sequence
  Description of Artificial Sequence: Synthetic oligonucleotide
taaaacaaaattaacaacaattaac

SEQ ID NO: 349 - DNA, 20 bp, Artificial Sequence
  Description of Artificial Sequence: Synthetic oligonucleotide
taagatggtttggtggatgt

SEQ ID NO: 350 - DNA, 21 bp, Artificial Sequence
  Description of Artificial Sequence: Synthetic oligonucleotide
aaatctctcactcaccctttc

SEQ ID NO: 351 - DNA, 19 bp, Artificial Sequence
  Description of Artificial Sequence: Synthetic oligonucleotide
ggtttggagttgttgagag

SEQ ID NO: 352 - DNA, 26 bp, Artificial Sequence
  Description of Artificial Sequence: Synthetic oligonucleotide
aaaaaaattaaaacaaaaacttaatc

SEQ ID NO: 353 - DNA, 24 bp, Artificial Sequence
  Description of Artificial Sequence: Synthetic oligonucleotide
atttttttttttagtttttttgat

SEQ ID NO: 354 - DNA, 20 bp, Artificial Sequence
  Description of Artificial Sequence: Synthetic oligonucleotide
caccctaacaactcttcact

SEQ ID NO: 355 - DNA, 20 bp, Artificial Sequence
  Description of Artificial Sequence: Synthetic oligonucleotide
ggggagaagaaaaaggaaag

SEQ ID NO: 356 - DNA, 29 bp, Artificial Sequence
  Description of Artificial Sequence: Synthetic oligonucleotide
aaaaaaaatattaaaaaaaaacactaaca

What is claimed is:

1. A method of detecting methylation or unmethylation of a ductal carcinoma in situ (DCIS) cell proliferation deoxyribonucleic acid (DNA) molecule of a human subject, the method comprising:
   (i) contacting an isolated DCIS cancer cell proliferation DNA molecule from a breast tissue sample of said subject with a bisulfate salt thereby forming a reacted DCIS cancer cell proliferation DNA molecule and contacting said reacted DCIS cancer cell proliferation DNA molecule with a probe or primer complementary to a sequence at or within 1000 nucleotides of a plurality of methylation sites; and
   (ii) detecting the presence or absence of uracil in said reacted DCIS cancer cell proliferation DNA molecule at said plurality of methylation sites, wherein said plurality of methylation sites is at Chromosome 1 (Chr1) position 4714314, Chromosome 3 (Chr3) position 121903470, Chromosome 4 (Chr4) position 44449864, Chromosome 7 (Chr7) position 157477232, Chromosome 12 (Chr12) position 95941925, Chr12 position 129338355, Chromosome 19 (Chr19) 30017283, and Chromosome 20 (Chr20) position 23016002 with respect to human genome assembly hg19,
   thereby detecting methylation or unmethylation of said DCIS cancer cell proliferation DNA molecule of said subject.

2. The method of claim 1, further comprising detecting the presence or absence of uracil in a plurality of reacted DCIS cancer cell proliferation DNA molecules at one or more additional methylation sites, wherein said one or more additional methylation sites is at Chr1 position 11413742, Chr1 position 39957798, Chr1 position 46951513, Chr1 position 47904912, Chr1 position 62660691, Chr1 position 63785800, Chr1 position 67600465, Chr1 position 91183172, Chr1 position 166853786, Chr1 position 179545096, Chr1 position 207669851, Chr1 position 237205704, Chr1 position 237205705, Chr1 position 240161215, Chr1 position 240934954, Chromosome 2 (Chr2) position 20870821, Chr2 position 45156764, Chr2 position 74743346, Chr2 position 80549703, Chr2 position 95989474, Chr2 position 105471544, Chr2 position 115919663, Chr2 position 115920004, Chr2 position 118982006, Chr2 position 177001540, Chr3 position 14852857, Chr3 position 170303393, Chr3 position 170303422, Chr3 position 170303423, Chr3 position 170303424, Chr3 position 170303425, Chr4 position 54976099, Chr4 position 56023880, Chromosome 5 (Chr5) positon 71014951, Chr5 position 72677229, Chr5 position 87981177, Chr5 position 140743998, Chr5 position 178421786, Chromosome 6 (Chr6) position 41337153, Chr6 position 85484102, Chr6 position 157557787, Chr6 position 160769248, Chr7 position 1282082, Chr7 position 32467637, Chr7 position 71801896, Chr7 position 71801905, Chr7 position 100946148, Chr7 position 100946151, Chr7 position 121957003, Chr7 position 150038502, Chr7 position 157477399, Chr7 position 157477401, Chromosome 8 (Chr8) position 9764011, Chr8 position 11566080, Chr8 position 11566102, Chr8 position 11566125, Chr8 position 56015232, Chr8 position 65281933, Chr8 position 145105472, Chromosome 9 (Chr9) position 126780185, Chr9 position 127239956, Chr9 position 140772369, Chromosome 10 (Chr10) position 8076277, Chr10 position 50818610, Chr10 position 77157527, Chr10 position 123778639, Chr10 position 123778640, Chr10 position 124902829, Chr10 position 124909545, Chr10 position 130085373, Chr10 position 134598235, Chr10 position 134599080, Chromosome 11 (Chr11) position 1215978, Chr11 position 9025912, Chr11 position 15963013, Chr11 position 66187593, Chr11 position 71318977, Chr11 position 101453451, Chr12 position 49726711, Chr12 position 50297756, Chr12 position 50297763, Chr12 position 50297768, Chr12 position 50297774, Chr12 position 50297776, Chr12 position 50444766, Chr12 position 75601447, Chr12 position 128750309, Chr12 position 129338471, Chromosome 13 (Chr13) position 28502190, Chr13 position 79181509, Chr13 position 92051154, Chr13 position 95363553, Chr13 position 95363592, Chromosome 14 (Chr14) position 29236052, Chr14 position 29236065, Chr14 position 101543886, Chromosome 15 (Chr15) position 29407958, Chr15 position 45403826, Chr15 position 76630094, Chr15 position 89951787, Chromosome 16 position 1255253, Chromosome 17 (Chr17) position 3211643, Chr17 position 30244229, Chr17 position 35294171, Chr17 position 64831307, Chr17 position 74136562, Chr17 position 74865566, Chromosome 18 (Chr18) position 19745047, Chr18 position 19745054, Chr18 position 19747206, Chr18 position 44774403, Chr18 position 55103840, Chr18 position 55106910, Chr18 position 70534832, Chr18 position 72880039, Chr18 position 77547934, Chr19 position 30016170, Chr19 position 30717013, Chr19 position 30719659, Chr20 position 1294019, Chr20 position 3073503, Chr20 position 10198305, Chr20 position 23015989, Chr20 position 26189258, Chr20 position 48626669, Chr20 position 53092916, Chr20 position 59827619, Chr20 position 59828325, Chromosome 21 (Chr21) position 9825842, Chr21 position 9826150, Chr21 position 9826934, or Chromosome 22 position 43807517 with respect to human genome assembly hg19.

3. The method of claim 2, wherein said plurality of methylation sites comprises at least about 10 additional methylation sites with respect to human genome assembly hg19.

4. The method of claim 2, wherein the uracil level of at least one methylation site of said plurality of methylation sites is above a threshold as set forth in Table 2, wherein Table 2 is as follows:

TABLE 2

| Chromosome | Chromosomal position | Uracil level in invasive competent DCIS is about above indicated level* |
|---|---|---|
| chr1 | 11413742 | 76.09 |
| chr1 | 240934954 | 78.57 |
| chr10 | 123778639 | 74.49 |
| chr10 | 123778640 | 79.31 |
| chr11 | 1215978 | 74.47 |
| chr12 | 128750309 | 83.33. |

5. The method of claim 1, wherein said DCIS cancer cell proliferation comprises cancer cells isolated from a sample obtained by biopsy, by laser capture microdissection, or by surgical resection of DCIS tissue from said subject.

6. The method of claim 1, wherein said subject has undergone lumpectomy, mastectomy, radiation therapy, and/or administration of an active agent.

7. The method of claim 6, wherein said active agent comprises trastuzumab, trastuzumab emtansine, lapatinib, pertuzumab, bevacizumab, tamoxifen, exemestane, anastrozole, letrozole, doxorubicin, epirubicin, cyclophosphamide, docetaxel, paclitaxel, nab paclitaxel, eribulin, everolimus, palbociclib, capecitabine, ixabepilone, methotrexate, or fluorouracil.

8. The method of claim 1, wherein said subject (a) is a woman; (b) is about 30 to about 75 years old; (c) has at least one mutant breast cancer 1 (BRCA1), breast cancer 2 (BRCA2), Partner and localizer of BRCA2 (PALB2), phosphatase and tensin homolog (PTEN), or p53 allele; (d) has a parent, sibling, or child who has been diagnosed with breast cancer; (e) has had atypical ductal hyperplasia or lobular carcinoma in situ; (f) has had previous radiation treatment to the chest or a breast before the age of 30; (g) has received a combination hormone therapy with estrogen and progestin for at least five years; and/or (h) has or has had breast cancer.

9. The method of claim 2, further comprising:

(i) detecting a level of uracil of at least one methylation site of said plurality of methylation sites that is equal to or less than the corresponding threshold level set forth in Table 3; and (ii) administering to said subject a treatment to treat or prevent invasive ductal carcinoma (IDC), wherein the treatment comprises (a) lumpectomy, mastectomy, radiation therapy, chemotherapy, or hormone therapy; or (b) administering an active agent comprising trastuzumab, trastuzumab emtansine, lapatinib, pertuzumab, bevacizumab, tamoxifen, exemestane, anastrozole, letrozole, doxorubicin, epirubicin, cyclophosphamide, docetaxel, paclitaxel, nab paclitaxel, eribulin, everolimus, palbociclib, capecitabine, ixabepilone, methotrexate, or fluorouracil;

wherein Table 3 is as follows:

TABLE 3

| Chromosome | Chromosomal position | Uracil level in invasive-competent DCIS is about below indicated level* |
|---|---|---|
| chr1 | 4714314 | 74.32 |
| chr1 | 39957798 | 63.81 |
| chr1 | 46951513 | 85.11 |
| chr1 | 47904912 | 73.08 |
| chr1 | 62660691 | 71.20 |
| chr1 | 63785800 | 46.94 |
| chr1 | 67600465 | 42.86 |
| chr1 | 91183172 | 48.28 |
| chr1 | 166853786 | 64.29 |
| chr1 | 179545096 | 88.89 |
| chr1 | 207669851 | 89.29 |
| chr1 | 237205704 | 82.61 |
| chr1 | 237205705 | 78.57 |
| chr1 | 240161215 | 60.00 |
| chr10 | 8076277 | 75.00 |
| chr10 | 50818610 | 76.30 |
| chr10 | 77157527 | 50.43 |
| chr10 | 124902829 | 67.35 |
| chr10 | 124909545 | 80.00 |
| chr10 | 130085373 | 76.74 |
| chr10 | 134598235 | 34.43 |
| chr10 | 134599080 | 79.31 |
| chr11 | 9025912 | 65.85 |
| chr11 | 15963013 | 51.72 |
| chr11 | 66187593 | 80.95 |
| chr11 | 71318977 | 51.52 |
| chr11 | 101453451 | 57.89 |
| chr12 | 49726711 | 60.00 |
| chr12 | 50297756 | 69.81 |
| chr12 | 50297763 | 82.98 |
| chr12 | 50297768 | 81.13 |
| chr12 | 50297774 | 75.47 |
| chr12 | 50297776 | 77.36 |
| chr12 | 50444766 | 54.17 |
| chr12 | 75601447 | 52.00 |
| chr12 | 95941925 | 36.84 |
| chr12 | 129338355 | 57.14 |
| chr12 | 129338471 | 60.71 |
| chr13 | 28502190 | 65.85 |
| chr13 | 79181509 | 79.84 |
| chr13 | 92051154 | 70.70 |
| chr13 | 95363553 | 73.91 |
| chr13 | 95363592 | 78.95 |
| chr14 | 29236052 | 72.36 |
| chr14 | 29236065 | 62.60 |
| chr14 | 101543886 | 92.45 |
| chr15 | 29407958 | 69.84 |
| chr15 | 45403826 | 73.68 |
| chr15 | 76630094 | 62.30 |
| chr15 | 89951787 | 39.68 |
| chr17 | 35294171 | 71.43 |
| chr17 | 64831307 | 56.52 |
| chr17 | 74136562 | 43.48 |
| chr17 | 74865566 | 62.79 |
| chr18 | 19745047 | 67.01 |
| chr18 | 19745054 | 64.10 |
| chr18 | 19747206 | 80.00 |
| chr18 | 44774403 | 68.29 |
| chr18 | 55103840 | 66.20 |
| chr18 | 55106910 | 50.00 |
| chr18 | 70534832 | 66.67 |
| chr18 | 77547934 | 33.33 |
| chr19 | 30016170 | 38.89 |
| chr19 | 30017283 | 60.00 |
| chr19 | 30717013 | 54.24 |
| chr19 | 30719659 | 66.67 |
| chr2 | 20870821 | 12.20 |
| chr2 | 45156764 | 34.25 |
| chr2 | 74743346 | 34.69 |
| chr2 | 80549703 | 28.21 |
| chr2 | 105471544 | 63.64 |
| chr2 | 115919663 | 64.44 |
| chr2 | 115920004 | 79.31 |
| chr2 | 118982006 | 47.06 |
| chr2 | 177001540 | 63.16 |
| chr20 | 1294019 | 55.43 |
| chr20 | 3073503 | 62.96 |
| chr20 | 10198305 | 62.44 |
| chr20 | 23015989 | 80.70 |
| chr20 | 23016002 | 65.59 |
| chr20 | 26189258 | 55.56 |
| chr20 | 48626669 | 36.00 |
| chr20 | 53092916 | 72.13 |
| chr20 | 59827619 | 58.82 |
| chr20 | 59828325 | 76.47 |
| chr21 | 9825842 | 37.32 |
| chr21 | 9826150 | 50.00 |
| chr21 | 9826934 | 53.36 |
| chr22 | 43807517 | 40.68 |
| chr3 | 14852857 | 57.54 |
| chr3 | 121903470 | 71.96 |
| chr3 | 170303393 | 68.63 |
| chr3 | 170303422 | 67.65 |
| chr3 | 170303423 | 81.82 |
| chr3 | 170303424 | 56.52 |
| chr3 | 170303425 | 69.77 |
| chr4 | 44449864 | 78.38 |
| chr4 | 54976099 | 72.00 |
| chr4 | 56023880 | 55.10 |
| chr5 | 71014951 | 65.00 |
| chr5 | 72677229 | 80.82 |
| chr5 | 87981177 | 55.26 |
| chr5 | 140743998 | 71.83 |
| chr5 | 178421786 | 56.25 |
| chr6 | 41337153 | 57.25 |
| chr6 | 85484102 | 68.18 |
| chr6 | 157557787 | 55.56 |
| chr6 | 160769248 | 75.51 |
| chr7 | 1282082 | 70.45 |
| chr7 | 32467637 | 31.03 |
| chr7 | 71801896 | 63.89 |
| chr7 | 71801905 | 63.89 |
| chr7 | 100946148 | 55.17 |
| chr7 | 100946151 | 43.66 |
| chr7 | 121957003 | 75.00 |
| chr7 | 150038502 | 84.83 |
| chr7 | 157477232 | 26.45 |
| chr7 | 157477399 | 71.43 |
| chr7 | 157477401 | 92.59 |
| chr8 | 9764011 | 70.91 |
| chr8 | 11566080 | 85.51 |
| chr8 | 11566102 | 65.22 |
| chr8 | 11566125 | 65.22 |
| chr8 | 56015232 | 53.85 |
| chr8 | 65281933 | 95.00 |
| chr8 | 145105472 | 44.93 |
| chr9 | 126780185 | 85.19 |
| chr9 | 127239956 | 66.96 |
| chr9 | 140772369 | 84.62. |

10. The method of claim 9, wherein said treatment comprises chemotherapy, or hormone therapy.

11. The method of claim 9, wherein treatment comprises administering to said subject the active agent comprising trastuzumab, trastuzumab emtansine, lapatinib, pertuzumab, bevacizumab, tamoxifen, exemestane, anastrozole, letrozole, doxorubicin, epirubicin, cyclophosphamide, docetaxel, paclitaxel, nab paclitaxel, eribulin, everolimus, palbociclib, capecitabine, ixabepilone, methotrexate, or fluorouracil.

12. The method of claim 9, wherein said treatment comprises a lumpectomy, mastectomy, and/or radiation therapy.

* * * * *